US008247181B2

(12) United States Patent
Barbour et al.

(10) Patent No.: US 8,247,181 B2
(45) Date of Patent: Aug. 21, 2012

(54) BORRELIA DIAGNOSTICS AND SCREENING METHODS

(75) Inventors: Alan G. Barbour, Newport Beach, CA (US); Philip L. Felgner, Rancho Sante Fe, CA (US)

(73) Assignee: The Regents of the University of California, Oakland, CA (US)

( * ) Notice: Subject to any disclaimer, the term of this patent is extended or adjusted under 35 U.S.C. 154(b) by 0 days.

(21) Appl. No.: 12/676,794

(22) PCT Filed: Sep. 8, 2008

(86) PCT No.: PCT/US2008/075613
§ 371 (c)(1),
(2), (4) Date: Jul. 15, 2010

(87) PCT Pub. No.: WO2009/033163
PCT Pub. Date: Mar. 12, 2009

(65) Prior Publication Data
US 2010/0278866 A1    Nov. 4, 2010

Related U.S. Application Data

(60) Provisional application No. 60/970,837, filed on Sep. 7, 2007.

(51) Int. Cl.
G01N 33/53    (2006.01)
(52) U.S. Cl. ......... 435/7.1; 435/7.2; 435/7.32; 435/7.92
(58) Field of Classification Search ........................ None
See application file for complete search history.

(56) References Cited

U.S. PATENT DOCUMENTS

| 5,977,339 A | 11/1999 | LeFebyre et al. |
| 6,509,017 B1 | 1/2003 | Bergstrom et al. |
| 2003/0059894 A1 | 3/2003 | Phillip |
| 2006/0034862 A1 | 2/2006 | Lahdenne et al. |

FOREIGN PATENT DOCUMENTS

| WO | 98/58943 | 12/1998 |

OTHER PUBLICATIONS

Jwang, B. et al., 1995, "The hook protein of *Borrelia burgdorferi*, encoded by the flgE gene, is serologically recognized in Lyme disease," Clin. Diagn. Lab Immunol. 2:609-615.
Kaiser et al., 1999, "Serodiagnosis of Neuroborreliosis: Comparison of Reliability of Three Confirmatory Assays,"Infection 27(3):177-182.
Kowalczewska, M. et al, 2006, Identification of candidate antigen in Whipple's disease using a serological proteomic approach, Proteomics 6:3294-3305.
Lam, T. T. et al., 1994, "A chromosomal *Borrelia burgdorferi* gene encodes a 22-kilodalton lipoprotein, P22, that is serologically recognized in Lyme disease," J. Clin Microbiol. 32:876-883.
Lawrenz, M. B. et al., 1999, "Human antibody responses to VlsE antigenic variation protein of *Borrelia burgdorferi*," J. Clin. Microbiol. 37:3997-4004.
Liang, F. T. et al., 2002, "DNA microarray assessment of putative *Borrelia burgdorferi* lipoprotein genes," Infect. Immun. 70:3300-3303.
Liang, F. T. et al, 1999, "Sensitive and specific serodiagnosis of Lyme disease by enzyme-linked immunosorbent assay with a peptide based on an immunodominant conserved region of *Borrelia burgdorferi* vlsE," J. Clin. Microbiol.37:3990-3996.
Lu, Z. et al., 2007, "Generation and characterization of hybridoma antibodies for immunotherapy of tularemia," Immunol. Lett. 112:92-103.
Luft, B. J., et al., 1991, "Immunologic and structural characterization of the dominant 66- to 73-kDa antigens of *Borrelia burgdorferi*" J. Immunol. 146:2776-2782.
Magnarelli, L. A. et al., 1996, "Use of recombinant antigens of *Borrelia burgdorferi* in serologic tests for diagnosis of Lyme Borreliosis," J. Clin. Microbiol. 34:237-240.
Marangoni et al., 2005, "Comparative evaluation of two enzyme linked immunosorbent assay methods and three Western Blot methods for the diagnosis of culture-confirmed early Lyme Borreliosis in Italy," New Microbiol 28(1):37-43.
McAtee, C. P. et al., 1998, "Identification of potential diagnostic and vaccine candidates of *Helicobacter pylori* by "proteome" technologies," Helicobacter 3:163-169.
McKevitt, M. et al., 2005, "Genome scale identification of *Treponema pallidum* antigens," Infect. Immun. 73:4445-4450.
Meier, J. T. et al., 1985, "Antigenic variation is associated with DNA rearrangements in a relapsing fever *Borrelia*," Cell 41:403-409.
Miller, J. C., and Stevenson, B., 2003, "Immunological and genetic characterization of *Borrelia burgdorferi* BapA and EppA proteins," Microbiology 149: 1113-1125.
Nigrovic, L. E., and Thompson, K. M., 2007, "The Lyme vaccine: a cautionary tale," Epidemiol. Infect. 135:1-8.
Nowalk, A. J. et al., 2006, "Serologic proteome analysis of *Borrelia burgdorferi* membrane-associated proteins," Infect. Immun. 74:3864-3873.
Nowalk, A. J. et al., 2006, "Comparative proteome analysis of subcellular fractions from *Borrelia burgdorferi* by NEPHGE and IPG," Proteomics 6:2121-2134.
Ojaimi, C. et al., 2002, "*Borrelia burgdorferi* gene expression profiling with membrane-based arrays," Methods Enzymol. 358:165-177.
Padula, S. J. et al., 1993, "Molecular characterization and expression of p23 (OspC) from a North American strain of *Borrelia burgdorferi*," Infect. Immun. 61:5097-5105.
Panelius, J. et al., 2001, "Recombinant flagellin A proteins from *Borrelia burgdorferi* sensu stricto, *B. afzelii*, and *B. garinii* in serodiagnosis of Lyme Borreliosis," J. Clin. Microbiol. 39:4013-4019.
Peltomaa et al., 2004, "the V1sE 6) Peptide ELISA in the Serodiagnosis of Lyme Facial Paralysis," (1R Otol Neurotol 25(5):838-841.
Porcella, S. F. et al., 2000, "Expression and immunological analysis of the plasmid-borne mlp genes of *Borrelia burgdorferi* strain B31," Infect. Immun. 68:4992-5001.

(Continued)

*Primary Examiner* — Jennifer Graser
(74) *Attorney, Agent, or Firm* — Casimir Jones, S.C.

(57) ABSTRACT

Compositions and methods of detecting *Borrelia* proteins, nucleic acid sequences encoding these proteins, and subject antibodies to these proteins in a sample are disclosed.

1 Claim, 8 Drawing Sheets

OTHER PUBLICATIONS

Probert, W. S., and Johnson, B. J., 1998, "Identification of a 47 kDa fibronectin-binding protein expressed by *Borrelia burgdorferi* isolate B31," Mol. Microbiol. 30:1003-1015.

Purser, J. E., and Norris, S. J., 2000, "Correlation between plasmid content and infectivity in *Borrelia burgdorferi*," Proc. Natl. Acad. Sci. USA 97:13865-13870.

Rasiah, C. et al., 1992, "Purification and characterization of a tryptic peptide of *Borrelia burgdorferi* flagellin, which reduces cross-reactivity in immunoblots and ELISA," J. Gen. Microbiol. 138:147-154.

Revel, A. T. et al., 2002, "DNA microarray analysis of differential gene expression in *Borrelia burgdorferi*, the Lyme disease spirochete," Proc. Natl. Acad. Sci. USA 99:1562-1567.

Roberts, D. M. et al., 2002, "Environmental regulation and differential production of members of the Bdr protein family of *Borrelia burgdorferi*," Infect. Immun. 70:7033-7041.

Roberts, W. C. et al., 1998, "Molecular analysis of sequence heterogeneity among genes encoding decorin binding proteins A and B of *Borrelia burgdorferi* sensu lato," Infect. Immun. 66:5275-5285.

Sadziene, A. et al., 1991, "A flagella-less mutant of *Borrelia burgdorferi*. Structural, molecular, and in vitro functional characterization," J. Clin. Investig. 88:82-92.

Salazar et al., 2005, "Lipoprotein-Dependent and -Independent Immune Responses to Spirochetal Infection," 12 (8):949-958.

Schwan et al., 1988, "Changes in infectivity and plasmid profile of the Lyme disease spirochete, *Borrelia burgdorferi*, as a result of in vitro cultivation," Infect. Immun. 56:1831-1836.

Schwan, T. G., and Piesman, J., 2000, "Temporal changes in outer surface proteins A and C of the Lyme disease-associated spirochete, *Borrelia burgdorferi*, during the chain of infection in ticks and mice," J. Clin. Microbiol. 38:382-388.

Schwan, T. G., J. Piesman, W. T. Golde, M. C. Dolan, and P. A. Rosa. 1995, "Induction of an outer surface protein on *Borrelia burgdorferi* during tick feeding" Proc. Natl. Acad. Sci. USA 92:2909-2913.

Steere, A. C., and Angelis, S. M., 2006, "Therapy for Lyme arthritis: strategies for the treatment of antibiotic-refractory arthritis," Arthritis Rheum. 54:3079-3086.

Steere, A. C. et al., 2004, "The emergence of Lyme disease," J. Clin. Investig. 113:1093-1101.

Steere, A. C. et al., 2003, "Prospective study of coinfection in patients with erythema migrans," Clin. Infect. Dis. 36:1078-1081.

Stevenson, B., et al., 1998, "*Borrelia burgdorferi* Erp proteins are immunogenic in mammals infected by tick bite, and their synthesis is inducible in cultured bacteria," Infect. Immun. 66:2648-2654.

Sundaresh, S. et al., 2006, "Identification of humoral immune responses in protein microarrays using DNA microarray data analysis techniques," Bioinformatics 22:1760-1766.

Sundaresh, S. et al., 2007, "From protein microarrays to diagnostic antigen discovery: a study of the pathogen *Francisella tularensis*," Bioinformatics 23:1508-1518.

Tokarz, R. et al., 2004, "Combined effects of blood and temperature shift on *Borrelia burgdorferi* gene expression as determined by whole-genome DNA array," Infect. Immun. 72:5419-5432.

Tsao, J. et al., 2001, "OspA immunization decreases transmission of *Borrelia burgdorferi* spirochetes from infected *Peromyscus leucopus* mice to larval *Ixodes scapularis* ticks," Vector Borne Zoonotic Dis. 1:65-74.

Ulvestad, E. et al., 2001, Diagnostic and biological significance of anti-p41 IgM antibodies against *Borrelia burgdorferi*, Scand. J. Immunol. 53:416-421.

Vaz, A. et al., 2001, "Cellular and humoral immune responses to *Borrelia burgdorferi* antigens in patients with culture-positive early Lyme disease," Infect. Immun. 69:7437-7444.

Wallich, R. et al., 1993, "Molecular and immunological characterization of a novel polymorphic lipoprotein of *Borrelia burgdorferi*," Infect. Immun. 61:4158-4166.

Wilske, B. et al., 1993, "Recombinant immunoblot in the serodiagnosis of Lyme borreliosis. Comparison with indirect immunofluorescence and enzyme-linked immunosorbent assay," Med. Microbiol. Immunol. 182:255-270.

Zhang, H. et al., 2005, "bdrF2 of Lyme disease spirochetes is coexpressed with a series of cytoplasmic proteins and is produced specifically during early infection," J. Bacteriol. 187:175-184.

Zückert, W. R., and Meyer, J., 1996, "Circular and linear plasmids of Lyme disease spirochetes have extensive homology: characterization of a repeated DNA element," J. Bacteriol. 178:2287-2298.

Zückert, W. R. et al., 1999, "Comparative analysis and immunological characterization of the *Borrelia* Bdr protein family," Infect. Immun. 67:3257-3266.

Aguero-Rosenfeld et al., 2005, "Diagnosis of lyme borreliosis," Clin. Microbiol. Rev. 18:484-509.

Barbour, A. G., 1984, Immunochemical analysis of Lyme disease spirochetes, Yale J. Biol. Med. 57:581-586.

Barbour, A. G., 1984, "Isolation and cultivation of Lyme disease spirochetes," Yale J. Biol. Med. 57:521-525.

Barbour, A. G., 1988, "Plasmid analysis of *Borrelia burgdorferi*, the Lyme disease agent" J. Clin. Microbiol. 26:475-478.

Barbour, A. G. et al., 1983, "Antibodies of patients with Lyme disease to components of the *Ixodes dammini* spirochete," J. Clin. Investig. 72:504-515.

Barbour, A. G. et al., 1986, "A *Borrelia*-specific monoclonal antibody binds to a flagellar epitope," Infect. Immun. 52:549-554.

Barbour, a. G. et al., 1983, "Lyme disease spirochetes and ixodid tick spirochetes share a common surface antigenic determinant defined by a monoclonal antibody," Infect. Immun. 41:795-804.

Brinkman, M. B. et al., 2006, "Reactivity of antibodies from syphilis patients to a protein array representing the *Treponema pallidum* proteome," J. Clin. Microbiol. 44:888-891.

Brisson, D., and Dykhuizen, D. E., 2004, "ospC diversity in *Borrelia burgdorferi*: different hosts are different niches," Genetics 168:713-722.

Brooks, C. S. et al., 2003, "Global analysis of *Borrelia burgdorferi* genes regulated by mammalian host-specific signals," Infect. Immun. 71:3371-3383.

Bunikis, J., and Barbour, A. G., 2002, "Laboratory testing for suspected Lyme Disease," Med. Clin. N. Am. 86:311-340.

Bunikis, J. et al., 2004, "Sequence typing reveals extensive strain diversity of the Lyme Borreliosis agents *Borrelia burgdorferi* in North America and *Borrelia afzelii* in Europe," Microbiology 150:1741-1755.

Bunikis, J. et al., 1998, "A surface-exposed region of a novel outer membrane protein (P66) of *Borrelia* spp. is variable in size and sequence," J. Bacteriol. 180:1618-1623.

Bunikis, J. et al., 1996, Surface exposure and species specificity of an immunoreactive domain of a 66-kilodalton outer membrane protein (P66) of the *Borrelia* spp. that cause Lyme disease, Infect. Immun. 64:5111-5116.

Bunikis, J. et al., 2004, "*Borrelia burgdorferi* infection in a natural population of *Peromyscus leucopus* mice: a longitudinal study in an area where Lyme borreliosis is highly endemic," J. Infect. Dis. 189:1515-1523.

Burgdorfer, W. et al., 1982, "Lyme disease—a tick-borne spirochetosis?" Science 216:1317-1319.

Cadavid, D. et al, 1997, "Immunologic and genetic analyses of VmpA of a neurotropic strain of *Borrelia turicatae*," Infect. Immun. 65:3352-3360.

Casjens, S. et al., 2000, "A bacterial genome in flux: the twelve linear and nine circular extrachromosomal DNAs in an infectious isolate of the Lyme disease spirochete *Borrelia burgdorferi*," Mol. Microbiol. 35:490-516.

Coleman, S. A. et al, 2007, Proteome and antigen profiling of *Coxiella burnetii* developmental forms, Infect. Immun. 75:290-298.

Connolly, J. P. et al., 2006, "Proteomic analysis of *Brucella abortus* cell envelope and identification of immunogenic candidate proteins for vaccine development," Proteomics 6:3767-3780.

Craft, J. E. et al., 1986, "Antigens of *Borrelia burgdorferi* recognized during Lyme disease. Appearance of a new immunoglobulin M response and expansion of the immunoglobulin G response late in the illness," J. Clin. Investig. 78:934-939.

Crother, T. R. et al., 2004, "Temporal analysis of the antigenic composition of *Borrelia burgdorferi* during infection in rabbit skin," Infect. Immun. 72:5063-5072.

Crotty, S. et al., 2003, "Cutting edge: long-term B cell memory in humans after smallpox Vaccination," J. Immunol. 171:4969-4973.

Daily, J. P. et al., 2005, "In vivo transcriptome of *Plasmodium falciparum* reveals overexpression of transcripts that encode surface proteins," J. Infect. Dis. 191:1196-1203.

Das, S. et al. 1996, "Characterization of a 30-kDa *Borrelia burgdorferi* substrate-binding protein homologue," Res. Microbiol. 147:739-751.

Davies, D. H. et al., 2005, "Profiling the humoral immune response to infection by using proteome microarrays: high-throughput vaccine and diagnostic antigen discovery," Proc. Natl. Acad. Sci. USA 102:547-552.

Davies, D. H. et al, 2005, "Vaccinia virus H3L envelope protein is a major target of neutralizing antibodies in humans and elicits protection against lethal challenge in mice," J. Virol. 79:11724-11733.

Davies, D. H. et al., 2007, "Proteome-wide analysis of the serological response to vaccinia and smallpox," Proteomics 7:1678-1686.

De Silva, A. M., and Fikrig, E., 1997, "Arthropod- and host-specific gene expression by *Borrelia burgdorferi*," J. Clin. Investig. 99:377-379.

Dressler, F. et al., 1993, "Western blotting in the serodiagnosis of Lyme disease," J. Infect. Dis. 167:392-400.

Engstrom, S. M. et al., 1995, "Immunoblot interpretation criteria for serodiagnosis of early Lyme disease," J. Clin. Microbiol. 33:419-427.

Eyles, J. E. et al., 2007, "Immunodominant *Francisella tularensis* antigens identified using proteome microarray," Crown copyright 2007 Dstl. Proteomics 7:2172-2183.

Feng, S. et al., 1995, "A 55-kilodalton antigen encoded by a gene on a *Borrelia burgdorferi* 49-kilobase plasmid is recognized by antibodies in sera from patients with Lyme disease," Infect. Immun. 63:3459-3466.

Feng, S. et al, 1998, "Humoral immunity to *Borrelia burgdorferi* N40 decorin binding proteins during infection of laboratory mice," Infect. Immun. 66:2827-2835.

Fikrig et al., 1997, "*Borrelia burgdorferi* P35 and P37 Proteins, Expressed in Vivo, Elicit Protective Immunity," Immunity 6(5):531-539.

Forgber, M. et al, 2006, "Mapping the antigenicity of the parasites in *Leishmania donovani* infection by proteome serology," PLoS One 1:e40.

Gardy, J. L. et al, 2005, "PSORTb v. 2.0: expanded prediction of bacterial protein subcellular localization and insights gained from comparative proteome analysis." Bioinformatics 21:617-623.

Ge et al., 1997, "Molecular characterization of large *Borrelia burgdorferi* motility operon which is initiated by a consensus .sigma.sup.70 promoter," J Bacteriology 179(7):2289-2299.

Gilmore, R. D., Jr., and Mbow, M. L., 1998, "A monoclonal antibody generated by antigen inoculation via tick bite is reactive to the *Borrelia burgdorferi* Rev protein, a member of the 2.9 gene family locus. Infect," Immun. 66:980-986.

Gilmore, R. D. et al., 1999, "The *Borrelia burgdorferi* 37-kilodalton immunoblot band (P37) used in serodiagnosis of early Lyme disease is the flaA gene product," J. Clin. Microbiol. 37:548-552.

Gilmore et al., 2001, "Analysis of *Borrelia burgdorferi* gene expression during life cycle phases of the tick vector *Ixodes scapularis*," Microbes Infect 3(10):799-808.

Glockner, G. et al., 2004, "Comparative analysis of the *Borrelia garinii* genome," Nucleic Acids Res. 32:6038-6046.

Goettner et al., 2005, "Improvement of Lyme Borreliosis Serodiagnosis by a Newly Developed Recombinant Immunoglobulin G (IgG) and IgM line Immunoblot Assay and Addition of VlsE and DbpA Homologues," J Clin Microbiol 43(8):3602-3609.

Haas, G. et al, 2002, "Immunoproteomics of *Helicobacter pylori* infection and relation to gastric disease," Proteomics 2:313-324.

Hansen, K. et al, 1988, "Measurement of antibodies to the *Borrelia burgdorferi* flagellum improves serodiagnosis in Lyme disease," J. Clin. Microbiol. 26:338-346.

Heikkila, T. et al., 2002, "Species-specific serodiagnosis of Lyme arthritis and neuroborreliosis due to *Borrelia burgdorferi* sensu stricto, *B. afzelii*, and *B. garinii* by using decorin binding protein," A. J. Clin. Microbiol. 40:453-460.

Heikkila, T. et al., 2003, "Recombinant or Peptide Antigens in the Serology of Lyme Arthritis in Children," J Infect Dis., 187(12):1888-1894.

Howe, T. R. et al., 1985, "A single recombinant plasmid expressing two major outer surface proteins of the Lyme disease spirochete," Science 227:645-646.

Jewett, M. W. et al, 2007, "The critical role of the linear plasmid lp36 in the infectious cycle of *Borrelia burgdorferi*," Mol. Microbiol. 64:1358-1374.

Johnson, B. J. et al., 1996, "Serodiagnosis of Lyme disease: accuracy of a two-step approach using a flagella-based ELISA and immunoblotting," J. Infect. Dis. 174:346-353.

Barbour, A.G. et al., 2008, "A Genome-Wide Proteome Array Reveals a Limited Set of Immunogens in Natural Infections of Humans and White-Footed Mice with *Borrelia burgdorferi*" Infection and Immunity, 2008, 76(8):3374-3389.

BORRELIA DIAGNOSTICS AND SCREENING METHODS

CROSS REFERENCE TO RELATED APPLICATIONS

The present application is a Section 371 U.S. National Stage Entry of pending International Patent Application No. PCT/US2008/075613, International Filing Date Sep. 8, 2008, which claims priority to U.S. Provisional Application Ser. No. 60/970,837, filed Sep. 7, 2007, both of which are herein incorporated by reference in their entireties.

STATEMENT REGARDING FEDERALLY SPONSORED RESEARCH OR DEVELOPMENT

The invention was made with government support under grant numbers AI24424, AI065359, AI072872, LM007743, and AR20358 awarded by the NIH, and grant number MRI EIA-0321390 awarded by the NSF. The government has certain rights in the invention.

FIELD OF THE INVENTION

The present invention relates to method of detecting *Borrelia* species in a sample (e.g., a sample from a patient suspected of being infected). In particular, the present invention provides compositions and methods for detecting the presence of *Borrelia* proteins, nucleic acid sequences encoding these proteins, and patient antibodies to these proteins, where the proteins are selected from those listed in Table 3, including: BB0279 (FLiL), BBK19, BBK07, BB0286 (FlbB), BBG33, BBL27, BBN34, BBP34, BBQ42, BBQ34, BBM34, BBN27, and BBH13.

BACKGROUND OF THE INVENTION

Lyme disease is the most frequently reported arthropod-borne disease in the United States and Europe (reviewed in ref (Steere, 2004). Serological assays are the most common laboratory tests used to confirm or support a diagnosis based on clinical features and epidemiologic circumstances (reviewed in (Bunikis, 2002; Aguero-Rosenfeld, 2005). Direct detection of the organism by cultivation, histology of a biopsy, or by an approved and validated polymerase chain reaction assay is generally preferable to serological assays for definitive confirmation of a clinical diagnosis but these procedures are uncommon in practice and not likely become widely used for the foreseeable future.

A clinical diagnosis of Lyme disease based on the observation of a characteristic skin rash and suitable epidemiologic features (e.g. exposure to ticks in an endemic area during the season of transmission) can have high accuracy (Steere, 2004). But in the absence of a skin rash (~20-30% of cases) diagnosis of early Lyme disease solely based on clinical and epidemiologic features is more difficult. Accurate diagnosis of early infection without the typical skin rash is important, because oral antibiotic treatment at this point is usually successful and will prevent the more serious manifestations of disseminated disease and late disease. Serologic assays for late disseminated Lyme disease are also important to help confirm a clinical diagnosis of potentially-treatable chronic infection. But a commonly used, if not recommended, practice is to use a serologic assay to "rule out" *B. burgdorferi* infection as an explanation of what may be long-standing symptoms, such as chronic joint pain, headache, cognitive problems, and fatigue. For diagnosis of early infection, a sensitive test is desirable to identify the infection at the earliest and most easily treatable point of the infection. For diagnosis of late disease, high sensitivity is also desirable but improved specificity is especially important because the test in practice is often applied in circumstances in which the a priori likelihood of *B. burgdorferi* infection is low (Bunikis, 2002).

Currently available commercial assays in the United States are either based on whole bacteria cell extracts, such as the enzyme-linked immunoabsorbent (ELISA) and Western blot assays, or on a single antigen ELISA such as the C6 peptide of the VlsE protein (Aguero-Rosenfeld, 2005). The whole cell assays are usually used as a 2-tiered test. First, a more sensitive, typically a whole cell ELISA, is used. This is followed by the more specific Western blot, if the ELISA is positive or equivocal (Control, 1997). Together these assays have served for years as the standard for serodiagnosis, but there remain trade-offs between sensitivity and specificity to minimize false-positive results. One drawback of the 2-tiered, sequential test procedure is the time it takes and the greater expense for two assays. Another problem with whole cell assays is a lack of standardization between tests of different manufacturers. The variables include different strains of *B. burgdorferi* that are used, different conditions for cultivating the organisms, and different methods for identifying the key antigens on blots.

Assays based on single proteins, such as the flagellin protein FlaB, or combinations of recombinant proteins are available in Europe (Hansen, 1988; Kaiser, 1999; Heikkila, 2003). In general, these have shown sensitivities and specificities approximately equivalent to the 2-tiered procedure. The recombinant antigens used singly or in combination are those that had been previously identified in whole cell Western blot assays using in-vitro cultivated cells. In the United States the most common subunit assays use a single peptide (called C6) of the VlsE protein or the full-length recombinant VlsE protein (Bacon, 2003). In some test formulations these single antigen assays had sensitivity for different stages of infection that was as good as the 2-tier procedure and better specificity (Lawrenz, 1999; Liang, 1999). But in other, more recent studies, including some from Europe, either the specificity or sensitivity of single antigen assays was not as good as tests based on two or more antigens or a 2-tiered procedure (Peltomaa, 2004; Marangoni, 2005; Goettner, 2005).

Perhaps the most important problem with currently available whole cell-based assays is that they utilize for their substrates bacteria that have been grown in vitro. The accumulated evidence=unequivocally shows that cells grown in vitro differ with respect to the expression of several proteins from cells recovered from infected animals (Fikrig, 1997; Gilmore, 2001; Salazar, 2005). While certain in vivo conditions can be duplicated to some extent in vitro by altering growth conditions, such as pH or cell density, there remain many proteins that appear to be only expressed in an infected animal or untreated patient.

SUMMARY OF THE INVENTION

The present invention provides methods of detecting *Borrelia* species in a sample (e.g., a sample from a patient suspected of being infected). In particular, the present invention provides compositions and methods for detecting the presence of *Borrelia* proteins, nucleic acid sequences encoding these proteins, and patient antibodies to these proteins, where the proteins are selected from those listed in Table 3, including: BB0279 (FLiL), BBK19, BBK07, BB0286 (FlbB), BBG33, BBL27, BBN34, BBP34, BBQ42, BBQ34, BBM34, BBN27, and BBH13.

In some embodiments, the present invention provides methods of detecting Borrelia in a patient sample comprising: contacting a sample with an antibody or other agent configured to bind a molecule selected from the group consisting of: BB0279 (FLiL), a BB0279 patient antibody, BBK19, a BBK19 patient antibody, BBK07, a BBK07 patient antibody, BB0286 (FlbB), a BB0286 patient antibody, BBG33, a BBG33 patient antibody, BBL27, a BBL27 patient antibody, BBN34, a BBN34 patient antibody, BBP34, a BBP34 patient antibody, BBQ42, a BBQ42 patient antibody, BBQ34, a BBQ34 patient antibody, BBM34, a BBM34 patient antibody, BBN27, a BBN27 patient antibody, BBH13, and a BBH13 patient antibody.

In certain embodiments, the contacting is performed with the antibody or a fragment of the antibody. In further embodiments, the other agent is one of the molecules that is not an antibody (e.g., BB0279, BBK19, etc.), and the presence or absence of one or more of the patient antibodies is detected (e.g., a BB0279 patient antibody or BBK19 patient antibody).

In particular embodiments, the *Borrelia* bacteria detected is *Borrelia burgdorferi*. In other embodiments, the *Borrelia* is *Borrelia afzelii* or *Borrelia garinii*. In certain embodiments, the *Borrelia* bacteria detected is selected from: *Borrelia afzelii*; *Borrelia anserina*; *Borrelia burgdorferi*; *Borrelia garinii*; *Borrelia hermsii*; *Borrelia recurrentis*; and *Borrelia valaisiana*.

In some embodiments, the present invention provides methods of detecting Borrelia in a sample comprising: contacting a sample with an nucleic acid sequence or nucleic acid sequences configured to detect a target nucleic acid sequence selected from the group consisting of: BB0279 (FLiL), BBK19, BBK07, BB0286 (FlbB), BBG33, BBL27, BBN34, BBP34, BBQ42, BBQ34, BBM34, BBN27, and BBH13.

In certain embodiments, the nucleic acid sequence is a probe that comprises a nucleotide sequence selected from the group consisting of: SEQ ID NO:15, SEQ ID NO:16, SEQ ID NO:19, SEQ ID NO:20, SEQ ID NO:115, SEQ ID NO:116, SEQ ID NO:119, SEQ ID NO:120, SEQ ID NO:125, SEQ ID NO:126, SEQ ID NO:131, SEQ ID NO:132, SEQ ID NO:143, SEQ ID NO:144, SEQ ID NO:151, SEQ ID NO:152, SEQ ID NO:157, SEQ ID NO:158, SEQ ID NO:161, SEQ ID NO:162, SEQ ID NO:173, SEQ ID NO:174, SEQ ID NO:185, SEQ ID NO:186, SEQ ID NO:191, SEQ ID NO:192 or any of the nucleic acid sequences (or portions thereof) shown in the accession numbers in Table 3.

In other embodiments, the nucleic acid sequences are a primer pair selected from the group consisting of: SEQ ID NO:15 and SEQ ID NO:16; SEQ ID NO:19 and SEQ ID NO:20; SEQ ID NO:115 and SEQ ID NO:116; SEQ ID NO:119 and SEQ ID NO:120; SEQ ID NO:125 and SEQ ID NO:126; SEQ ID NO:131 and SEQ ID NO:132; SEQ ID NO:143 and SEQ ID NO:144; SEQ ID NO:151 and SEQ ID NO:152; SEQ ID NO:157 and SEQ ID NO:158; SEQ ID NO:161 and SEQ ID NO:162; SEQ ID NO:173 and SEQ ID NO:174; SEQ ID NO:185 and SEQ ID NO:186; and SEQ ID NO:191 and SEQ ID NO:192.

In particular embodiments, the present invention provides methods of vaccinating a person against Borrelia infection, comprising: administering a composition to a patient comprising an isolated protein selected from the group consisting of: BB0279 (FLiL), BBK19, BBK07, BB0286 (FlbB), BBG33, BBL27, BBN34, BBP34, BBQ42, BBQ34, BBM34, BBN27, and BBH13.

In certain embodiments, the present invention provides compositions suitable for injection to a human (or domesticated animal) comprising: i) an adjuvant and/or physiological tolerable buffer, and ii) an isolated protein selected from the group consisting of: BB0279 (FLiL), BBK19, BBK07, BB0286 (FlbB), BBG33, BBL27, BBN34, BBP34, BBQ42, BBQ34, BBM34, BBN27, and BBH13.

In other embodiments, the present invention provides methods of detecting Borrelia in a sample comprising: contacting a sample with an antibody or other agent configured to bind a molecule selected from an antigen recited in Table 3 or an antibody to an antigen in Table 3.

In some embodiments, the present invention provides methods of detecting Borrelia in a sample comprising: contacting a sample with an antibody or other agent configured to bind a molecule selected from the group consisting of: BBG33 or antibody thereof; BB0279 or antibody thereof; BBL27 or antibody thereof BBN34 or antibody thereof BBP34 or antibody thereof BBQ42 or antibody thereof BBQ34 or antibody thereof BBM34 or antibody thereof BBN27 or antibody thereof BBH13 or antibody thereof BBO34 or antibody thereof BBQ03 or antibody thereof BBN11 or antibody thereof OspC_A or antibody thereof BBO39 or antibody thereof BBF03 or antibody thereof BBK19 or antibody thereof BBI42 or antibody thereof BBB14 or antibody thereof BB0348 or antibody thereof BBH06 or antibody thereof BBN38 or antibody thereof BB0215 or antibody thereof OspC_K or antibody thereof BBA36 or antibody thereof BBL40 or antibody thereof BB0359 or antibody thereof BBR42 or antibody thereof BBJ24 or antibody thereof BB0543 or antibody thereof BB0774 or antibody thereof BB0844 or antibody thereof BBN39 or antibody thereof BBK12 or antibody thereof BBA07 or antibody thereof BBK07 or antibody thereof BBA57 or antibody thereof BB0323 or antibody thereof BB0681 or antibody thereof BBA03 or antibody thereof BBB09 or antibody thereof BB0238 or antibody thereof BBA48 or antibody thereof BB0408 or antibody thereof BBK53 or antibody thereof BBR35 or antibody thereof BBS41 or antibody thereof BB0286 or antibody thereof BB0385 or antibody thereof and BBG18 or antibody thereof.

In particular embodiments, the present invention provides methods of detecting Borrelia in a sample comprising: contacting a sample with a nucleic acid sequence or nucleic acid sequences configured to detect at least one target nucleic acid sequence of an antigen recited in Table 3. In some embodiments, the at least one target nucleic acid sequence is selected from the group consisting of: BBG33; BB0279; BBL27; BBN34; BBP34; BBQ42; BBQ34; BBM34; BBN27; BBH13; BB034; BBQ03; BBN11; OspC_A; BBO39; BBF03; BBK19; BBI42; BBB14; BB0348; BBH06; BBN38; BB0215; OspC_K; BBA36; BBL40; BB0359; BBR42; BBJ24; BB0543; BB0774; BB0844; BBN39; BBK12; BBA07; BBK07; BBA57; BB0323; BB0681; BBA03; BBB09; BB0238; BBA48; BB0408; BBK53; BBR35; BBS41; BB0286; BB0385; and BBG18. In further embodiments, the nucleic acid sequences comprises at least one nucleic acid sequence selected from SEQ ID NOs:1-202.

In some embodiments, the present invention provides methods of vaccinating a person against Borrelia, comprising: administering a composition to a patient comprising at least one isolated protein from Table 3. In particular embodiments, the at least one isolated protein is selected from the group consisting of: BBG33; BB0279; BBL27; BBN34; BBP34; BBQ42; BBQ34; BBM34; BBN27; BBH13; BB034; BBQ03; BBN11; OspC_A; BBO39; BBF03; BBK19; BBI42; BBB14; BB0348; BBH06; BBN38;

BB0215; OspC_K; BBA36; BBL40; BB0359; BBR42; BBJ24; BB0543; BB0774; BB0844; BBN39; BBK12; BBA07; BBK07; BBA57; BB0323; BB0681; BBA03; BBB09; BB0238; BBA48; BB0408; BBK53; BBR35; BBS41; BB0286; BB0385; and BBG18.

In additional embodiments, the present invention provides compositions suitable for injection to a human, or domesticated animal, comprising: i) an adjuvant and/or physiological tolerable buffer, and ii) an isolated protein from Table 3. In particular embodiments, the at least one isolated protein is selected from the group consisting of: BBG33; BB0279; BBL27; BBN34; BBP34; BBQ42; BBQ34; BBM34; BBN27; BBH13; BBO34; BBQ03; BBN11; OspC_A; BB039; BBF03; BBK19; BBI42; BBB14; BB0348; BBH06; BBN38; BB0215; OspC_K; BBA36; BBL40; BB0359; BBR42; BBJ24; BB0543; BB0774; BB0844; BBN39; BBK12; BBA07; BBK07; BBA57; BB0323; BB0681; BBA03; BBB09; BB0238; BBA48; BB0408; BBK53; BBR35; BBS41; BB0286; BB0385; and BBG18.

In some embodiments, the present invention provides methods of detecting *Borrelia* in a sample comprising: contacting a sample with an antibody or other agent configured to bind a molecule selected from the group consisting of: BBK07, a BBK07 ortholog, a BBK07 antibody, BBK12, a BBK12 ortholog, a BBK12 antibody, BBK19, a BBK19 ortholog, a BBK antibody, FLiL, a FLiL ortholog, a FLiL antibody, FlbB, a FlbB ortholog, or a FlbB antibody.

In other embodiments, the present invention provides methods of detecting *Borrelia* in a sample comprising: contacting a sample with an nucleic acid sequence or nucleic acid sequences configured to detect a target nucleic acid sequence selected from the group consisting of: bbk07, a bbk07 ortholog, bbk12, a bbk12 ortholog, bbk19, a bbk19 ortholog, flil, a flil ortholog, flbb, or a flbbB ortholog.

In certain embodiments, the present invention provides methods for vaccinating a subject (e.g., a person) against *Borrelia*, comprising: administering a composition to a patient comprising an isolated protein selected from the group consisting of: BBK07, a BBK07 ortholog, BBK12, a BBK12 ortholog, BBK19, a BBK19 ortholog, FLiL, a FLiL ortholog, FlbB, or a FlbB ortholog.

In further embodiments, the present invention provides compositions suitable for injection to an animal (e.g., human) comprising: i) an adjuvant and/or physiological tolerable buffer, and ii) an isolated protein selected from the group consisting of: BBK07, a BBK07 ortholog, BBK12, a BBK12 ortholog, BBK19, a BBK19 ortholog, FLiL, a FLiL ortholog, FlbB, or a FlbB ortholog.

DESCRIPTION OF THE DRAWINGS

FIG. 3 shows scatter plots of array intensity values normalized in units of SDs above or below the mean for the controls of each panel. Each plot shows values for pairs of selected Orfs reacted with sera of controls (dark gray circles) and patients with early LB (blue multiplication signs) or later LB (light gray X's) of panels 1 and 2. The coefficients of determination ($R^2$) for all plots, as well as the linear regression equations for the upper two plots, are shown. The levels of identity of aligned amino acid sequences of the three pairs of homologous proteins are indicated; BBK07 and BBA25 are not significantly (NS) similar.

FIG. 6 shows a Western blot analysis, from Example 1, of whole-cell lysates of low-passage and high-passage *B. burgdorferi* strain B31 with mouse antiserum to recombinant BBK12 or with murine monoclonal antibodies to BBA15 (OspA) or BB0147 (FlaB).

DEFINITIONS

Figure 1:
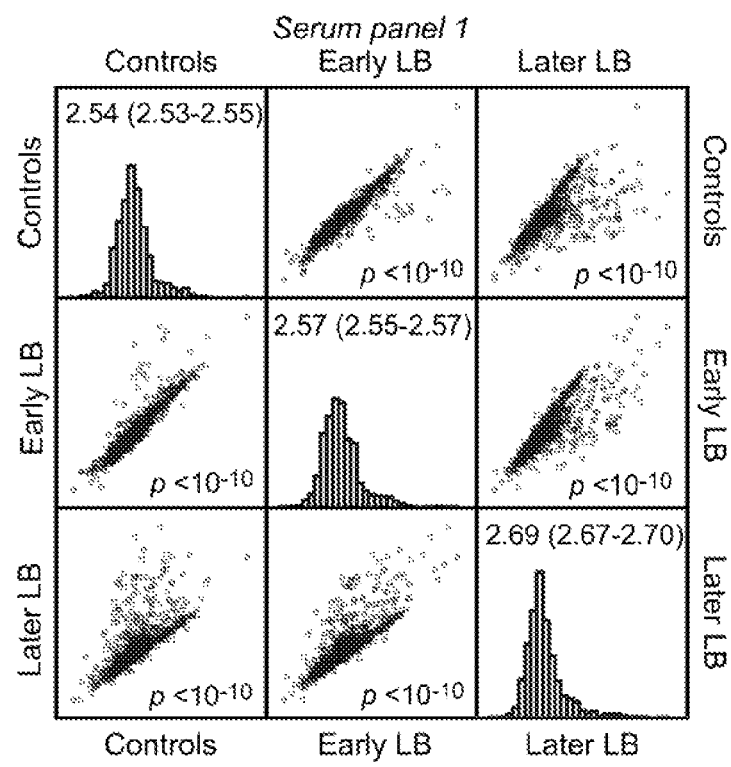
FIG. 1 shows an overview of genome-wide proteome array results obtained with sera from humans with LB as described in Example 1. The graphs are two sets of frequency histograms and scatter plots of binding of antibodies in FIG. 1A and (upper panel) and FIG. 1B (lower panel) sera from controls and patients with early or later LB to an array of recombinant proteins produced in vitro from a total of 1,293 *B. burgdorferi* ORFs (1,292 ORFs from strain B31 and 1 ORF from strain 297). In the frequency histograms the x axes indicate relative $\log_{10}$ intensity values, and the y axes indicate the relative counts on an interval scale. In the scatter plots, both the x and y axes indicate relative $\log_{10}$ intensity values. The distributions in the frequency histograms are indicated along with the medians of $\log_{10}$ intensity values with 95% confidence intervals. The scatter plots include two-sided P values obtained by using an exact Wilcoxon signed rank test.
Figure 1:
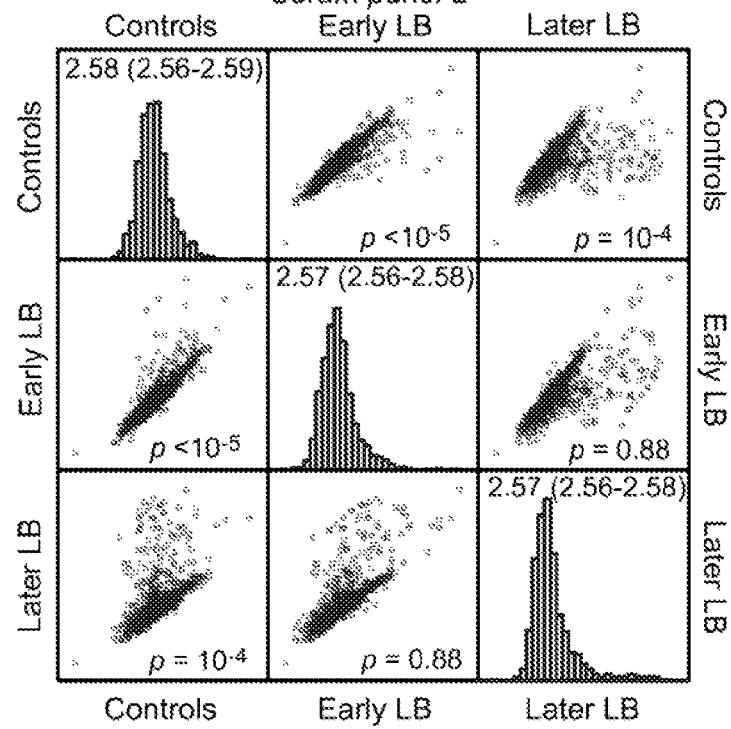

The term "epitope" as used herein refers to that portion of an antigen that makes contact with a particular antibody. When a protein or fragment of a protein (e.g., those described by accession number in Table 3) is used to immunize a host animal, numerous regions of the protein may induce the production of antibodies which bind specifically to a given region or three-dimensional structure on the protein; these regions or structures are referred to as "antigenic determinants". An antigenic determinant may compete with the intact antigen (i.e., the "immunogen" used to elicit the immune response) for binding to an antibody.

The terms "specific binding" or "specifically binding" when used in reference to the interaction of an antibody and a protein or peptide means that the interaction is dependent upon the presence of a particular structure (i.e., the antigenic determinant or epitope) on the protein; in other words the antibody is recognizing and binding to a specific protein structure rather than to proteins in general. For example, if an antibody is specific for epitope "A," the presence of a protein containing epitope A (or free, unlabelled A) in a reaction containing labeled "A" and the antibody will reduce the amount of labeled A bound to the antibody.

As used herein, the terms "non-specific binding" and "background binding" when used in reference to the interaction of an antibody and a protein or peptide refer to an interaction that is not dependent on the presence of a particular structure (i.e., the antibody is binding to proteins in general rather that a particular structure such as an epitope).

As used herein, the term "subject" refers to any animal (e.g., a mammal), including, but not limited to, humans, non-human primates, rodents, and the like, which is to be the recipient of a particular treatment. Typically, the terms "subject" and "patient" are used interchangeably herein in reference to a human subject.

As used herein, the term "subject suspected of being infected with a *Borrelia* species" refers to a subject that presents one or more symptoms indicative of such infection (see, e.g., NIH guidelines for such infections). A subject suspected of being infected with *Borrelia* species (e.g., burgdorferi) may also have one or more risk factors (e.g., exposure to ticks). A subject suspected of infection generally not been tested for such infection.

A "patient antibody," as used herein, is an antibody generated in a patient (e.g., human) as a result of infection with a *Borrelia* bacteria. In other words, it is the patient's own antibodies generated as a result of infection. Such antibodies provide evidence of infection and are therefore useful to detect in order to provide a diagnosis of *Borrelia* infection.

As used herein, the term "instructions for using said kit for detecting *Borrelia* infection in said subject" includes instructions for using the reagents contained in the kit for the detection and characterization of *Borrelia* infection in a sample from a subject. In some embodiments, the instructions further comprise the statement of intended use required by the U.S. Food and Drug Administration (FDA) in labeling in vitro diagnostic products. The present invention contemplates kits with reagents for detecting *Borrelia* infection, including antibodies to the antigens recited in Table 3, and nucleic acids sequences (e.g., primer pairs from Table 4).

As used herein, the term "primer" refers to an oligonucleotide, whether occurring naturally as in a purified restriction digest or produced synthetically, that is capable of acting as a point of initiation of synthesis when placed under conditions in which synthesis of a primer extension product that is complementary to a nucleic acid strand is induced, (i.e., in the presence of nucleotides and an inducing agent such as DNA polymerase and at a suitable temperature and pH). The primer is preferably single stranded for maximum efficiency in amplification, but may alternatively be double stranded. If double stranded, the primer is first treated to separate its strands before being used to prepare extension products. Preferably, the primer is an oligodeoxyribonucleotide. The primer must be sufficiently long to prime the synthesis of extension products in the presence of the inducing agent. The exact lengths of the primers will depend on many factors, including temperature, source of primer and the use of the method. Exemplary primers for detecting the *Borrelia* target nucleic acids of the present invention are provided in Table 4, which contains 101 primer pairs (SEQ ID NOs:1-202). One of skill in the art could design similar primers given that the nucleic acid sequences are known in the art for the *Borrelia* antigens (Table 3 useful nucleic acid sequence accession numbers).

As used herein, the term "probe" refers to an oligonucleotide (i.e., a sequence of nucleotides), whether occurring naturally as in a purified restriction digest or produced synthetically, recombinantly or by PCR amplification, that is capable of hybridizing to at least a portion of another oligonucleotide of interest. A probe may be single-stranded or double-stranded. Probes are useful in the detection, identification and isolation of particular gene sequences. It is contemplated that any probe used in the present invention will be labeled with any "reporter molecule," so that is detectable in any detection system, including, but not limited to enzyme (e.g., ELISA, as well as enzyme-based histochemical assays), fluorescent, radioactive, and luminescent systems. It is not intended that the present invention be limited to any particular detection system or label. The primers listed in Table 4 could also be used as probes (e.g., by labeling these sequences) to detect *Borrelia* antigens.

As used herein the term "portion" when in reference to a nucleotide sequence (as in "a portion of a given nucleotide sequence") refers to fragments of that sequence. The fragments may range in size from four nucleotides to the entire nucleotide sequence minus one nucleotide (10 nucleotides, 20, 30, 40, 50, 100, 200, etc.).

DESCRIPTION OF THE INVENTION

The present invention provides methods of detecting *Borrelia* species in a sample (e.g., a sample from a patient suspected of being infected). In particular, the present invention provides compositions and methods for detecting the presence of *Borrelia* proteins, nucleic acid sequences encoding these proteins, and patient antibodies to these proteins, where the proteins are selected from those listed in Table 3, including: BB0279 (FLiL), BBK19, BBK07, BB0286 (FlbB), BBG33, BBL27, BBN34, BBP34, BBQ42, BBQ34, BBM34, BBN27, and BBH13.

I. *Borrelia* Antigens

The present invention provides numerous proteins and nucleic acid targets that can be detected in order to diagnose *Borrelia* infection. Table 3 below lists the ORFs that were found to be antigenic during the development of the present invention. Table 3 also lists the accession numbers where the protein and nucleic acid sequences for these antigens can be found. These accession numbers allow one skilled in the art to easily design probes and primers to the corresponding nucleic acid sequences. These accession numbers (herein incorporated by reference as if fully set forth herein) also allow one of skill in the art to express these proteins in order to generate antibodies and antibody fragments useful for detecting *Borrelia* infection.

TABLE 3

| ORF | SEQ ID NO. | Deduced gene product | Accession Nos. for Nucleic and Amino Acid Sequences |
|---|---|---|---|
| BB0056 | 212 | Phosphoglycerate kinase | NC_001318 |
| BB0108 | 213 | Peptidylprolyl isomerase | NC_001318 |
| BB0181 | 214 | Flagellar hook-associated protein (FlgK) | NC_001318 |
| BB0215 | 215 | Phosphate ABC transporter (PstS) | NC_001318 |
| BB0238 | 216 | Hypothetical protein | NC_001318 |
| BB0260 | 217 | Hypothetical protein | NC_001318 |
| BB0279 | 218 | Flagellar protein (FliL) | NC_001318 |
| BB0286 | 219 | Flagellar protein (FlbB) | NC_001318 |
| BB0323 | 220 | Hypothetical protein | NC_001318 |
| BB0337 | 221 | Enolase | NC_001318 |
| BB0348 | 222 | Pyruvate kinase | NC_001318 |
| BB0359 | 223 | Carboxy-terminal protease | NC_001318 |
| BB0385 | 224 | Basic membrane protein D (BmpD) | NC_001318 |
| BB0408 | 225 | Phosphotransferase system, fructose-specific IIABC | NC_001318 |
| BB0476 | 226 | Translation elongation factor TU (Tuf) | NC_001318 |
| BB0543 | 227 | Hypothetical protein | NC_001318 |
| BB0652 | 228 | Protein export protein (SecD) | NC_001318 |
| BB0668 | 229 | Flagellar filament outer layer protein (FlaA) | NC_001318 |
| BB0681 | 230 | Methyl-accepting chemotaxis protein | NC_001318 |
| BB0751 | 231 | Hypothetical protein | NC_001318 |
| BB0772 | 232 | Flagellar P-ring protein (FlgI) | NC_001318 |
| BB0774 | 233 | Flagellar basal body cord protein (FlgG) | NC_001318 |
| BB0805 | 234 | Polyribonucleotidyltransferase (PnpA) | NC_001318 |
| BB0811 | 235 | Hypothetical protein (COG1413) | NC_001318 |
| BB0844 | 236 | Hypothetical protein | NC_001318 |
| BBA03 | 237 | Hypothetical protein | NC_001857 |
| BBA07 | 238 | Hypothetical protein | NC_001857 |
| BBA19 | 239 | Hypothetical protein | NC_001857 |
| BBA36 | 240 | Hypothetical protein | NC_001857 |
| BBA40 | 241 | Hypothetical protein | NC_001857 |
| BBA48 | 242 | Hypothetical protein | NC_001857 |
| BBA57 | 243 | Hypothetical protein | NC_001857 |
| BBB09 | 244 | Hypothetical protein | NC_001903 |
| BBB14 | 245 | Hypothetical protein | NC_001903 |
| BBC03 | 246 | Hypothetical protein | NC_001904 |
| BBE09 | 247 | Hypothetical protein | NC_001850 |
| BBF03 | 248 | BdrS (BdrF1) | NC_001851 |
| BBG18 | 249 | Hypothetical protein | NC_001852 |
| BBG33 | 250 | BdrT (BdrF2) | NC_001852 |
| BBH06 | 251 | Hypothetical protein | NC_001853 |
| BBH13 | 252 | BdrU (BdrF3) | NC_001853 |
| BBI42 | 253 | Hypothetical protein | NC_001854 |
| BBJ24 | 254 | Hypothetical protein | NC_001856 |
| BBK07 | 255 | Hypothetical protein | NC_001855 |
| BBK12 | 256 | Hypothetical protein | NC_001855 |
| BBK13 | 257 | Hypothetical protein (COG2859) | NC_001855 |
| BBK19 | 258 | Hypothetical protein | NC_001855 |
| BBK23 | 259 | Hypothetical protein | NC_001855 |
| BBK52 | 260 | "P23" | NC_001855 |
| BBK53 | 261 | Hypothetical protein | NC_001855 |
| BBL03 | 262 | Hypothetical protein | NC_000953 |
| BBL27 | 263 | BdrO (BdrE1) | NC_000953 |
| BBL39 | 264 | ErpN (CRASP-5) | NC_000953 |
| BBL40 | 265 | ErpO | NC_000953 |
| BBM34 | 266 | BdrK (BdrD2) | NC_000951 |
| BBM36 | 267 | Hypothetical protein | NC_000951 |
| BBN11 | 268 | Hypothetical protein | NC_000954 |
| BBN27 | 269 | BdrR (BdrE2) | NC_000954 |
| BBN34 | 270 | BdrQ (BdrD10) | NC_000954 |
| BBN38 | 271 | ErpP (CRASP-3) | NC_000954 |
| BBN39 | 272 | ErpQ | NC_000954 |
| BBO34 | 273 | BdrM (BdrD3) | NC_000952 |
| BBO39 | 274 | ErpL | NC_000952 |
| BBO40 | 275 | ErpM | NC_000952 |
| BBP34 | 276 | BdrA (BdrD4) | NC_000948 |
| BBP39 | 277 | ErpB | NC_000948 |
| BBQ03 | 278 | Hypothetical protein | AE001584 |

TABLE 3-continued

| ORF | SEQ ID NO. | Deduced gene product | Accession Nos. for Nucleic and Amino Acid Sequences |
|---|---|---|---|
| BBQ04 | 279 | Hypothetical protein | AE001584 |
| BBQ13 | 280 | Hypothetical protein | AE001584 |
| BBQ19 | 281 | Hypothetical protein | AE001584 |
| BBQ34 | 282 | BdrW (BdrE6) | AE001584 |
| BBQ40 | 283 | Partition protein | AE001584 |
| BBQ42 | 284 | BdrV (BdrD5) | AE001584 |
| BBR12 | 285 | Hypothetical protein | NC_000950 |
| BBR35 | 286 | BdrG | NC_000950 |
| BBR42 | 287 | ErpY | NC_000950 |
| BBS41 | 288 | ErpG | NC_000949 |

II. Detection of *Borrelia* Infection

In some embodiments, the present invention provides methods for detection of the *Borrelia* antigens listed in Table 3. In some embodiments, expression is detected in bodily fluids (e.g., including but not limited to, plasma, serum, whole blood, mucus, and urine). In certain embodiments, multiple antigens are detected (e.g., two or more antigens from Table 3 or one antigen from Table 3 and one antigen presently known in the art). In certain embodiments, at least 2 . . . 5 . . . 10 . . . 20 . . . 35 . . . 50 . . . or 100 antigens are detected from a single patient sample.

In some embodiments, the presence of a Table 3 *Borrelia* antigen is used to provide a prognosis to a subject. The information provided is also used to direct the course of treatment.

1. Detection of Nucleic Acid

In some embodiments, detection of Table 3 *Borrelia* antigens are detected by measuring the existence of nucleic acid encoding such antigens in a patient sample. Table 3 lists the accession numbers for each of the antigens which allows one of skill in the art to design primers and probes to such sequences. Exemplary primers for each of these antigens are shown in Table 4.

In some embodiments, nucleic acid is detected by Northern blot analysis. Northern blot analysis involves the separation of nucleic acid and hybridization of a complementary labeled probe.

In still further embodiments, nuclei acid is detected by hybridization to an oligonucleotide probe). A variety of hybridization assays using a variety of technologies for hybridization and detection are available. For example, in some embodiments, TaqMan assay (PE Biosystems, Foster City, Calif.; See e.g., U.S. Pat. Nos. 5,962,233 and 5,538,848, each of which is herein incorporated by reference) is utilized. The assay is performed during a PCR reaction. The TaqMan assay exploits the 5'-3' exonuclease activity of the AMPLITAQ GOLD DNA polymerase. A probe consisting of an oligonucleotide with a 5'-reporter dye (e.g., a fluorescent dye) and a 3'-quencher dye is included in the PCR reaction. During PCR, if the probe is bound to its target, the 5'-3' nucleolytic activity of the AMPLITAQ GOLD polymerase cleaves the probe between the reporter and the quencher dye. The separation of the reporter dye from the quencher dye results in an increase of fluorescence. The signal accumulates with each cycle of PCR and can be monitored with a fluorimeter.

In other embodiments, nucleic acid is detected using a detection assay including, but not limited to, enzyme mismatch cleavage methods (e.g., Variagenics, U.S. Pat. Nos. 6,110,684, 5,958,692, 5,851,770, herein incorporated by reference in their entireties); polymerase chain reaction; branched hybridization methods (e.g., Chiron, U.S. Pat. Nos. 5,849,481, 5,710,264, 5,124,246, and 5,624,802, herein incorporated by reference in their entireties); rolling circle replication (e.g., U.S. Pat. Nos. 6,210,884, 6,183,960 and 6,235,502, herein incorporated by reference in their entireties); NASBA (e.g., U.S. Pat. No. 5,409,818, herein incorporated by reference in its entirety); molecular beacon technology (e.g., U.S. Pat. No. 6,150,097, herein incorporated by reference in its entirety); E-sensor technology (Motorola, U.S. Pat. Nos. 6,248,229, 6,221,583, 6,013,170, and 6,063,573, herein incorporated by reference in their entireties); cycling probe technology (e.g., U.S. Pat. Nos. 5,403,711, 5,011,769, and 5,660,988, herein incorporated by reference in their entireties); Dade Behring signal amplification methods (e.g., U.S. Pat. Nos. 6,121,001, 6,110,677, 5,914,230, 5,882,867, and 5,792,614, herein incorporated by reference in their entireties); ligase chain reaction (Barnay Proc. Natl. Acad. Sci USA 88, 189-93 (1991)); FULL-VELOCITY assays; and sandwich hybridization methods (e.g., U.S. Pat. No. 5,288,609, herein incorporated by reference in its entirety). In other embodiments, the detection assay employed is the INVADER assay (Third Wave Technologies) which is described in U.S. Pat. Nos. 5,846,717, 5,985,557, 5,994,069, 6,001,567, and 6,090,543, WO 97/27214 WO 98/42873, Lyamichev et al., Nat. Biotech., 17:292 (1999), Hall et al., PNAS, USA, 97:8272 (2000), each of which is herein incorporated by reference in their entirety for all purposes).

2. Detection of Protein

In some embodiments, the proteins expressed by the ORFs listed in Table 3 are detected. Protein expression can be detected by any suitable method. In some embodiments, proteins are detected by immunohistochemistry. In other embodiments, proteins are detected by their binding to an antibody raised against the protein. The generation of antibodies is described below.

Antibody binding is detected by techniques known in the art (e.g., radioimmunoassay, ELISA (enzyme linked immunosorbant assay), "sandwich" immunoassays, immunoradiometric assays, gel diffusion precipitation reactions, immunodiffusion assays, in situ immunoassays (e.g., using colloidal gold, enzyme or radioisotope labels, for example), Western blots, precipitation reactions, agglutination assays (e.g., gel agglutination assays, hemagglutination assays, etc.), complement fixation assays, immunofluorescence assays, protein A assays, and immunoelectrophoresis assays, etc.

In certain embodiments, antibody binding is detected by detecting a label on the primary antibody. In another embodiment, the primary antibody is detected by detecting binding of a secondary antibody or reagent to the primary antibody. In a further embodiment, the secondary antibody is labeled. Many methods are known in the art for detecting binding in an immunoassay and are within the scope of the present invention.

In some embodiments, an automated detection assay is utilized. Methods for the automation of immunoassays include those described in U.S. Pat. Nos. 5,885,530, 4,981,785, 6,159,750, and 5,358,691, each of which is herein incorporated by reference. In some embodiments, the analysis and presentation of results is also automated. In other embodiments, the immunoassay described in U.S. Pat. Nos. 5,599,677 and 5,672,480 (each of which is herein incorporated by reference) is utilized.

3. Antibodies and Antibody Fragments

The present invention provides isolated antibodies and antibody fragments against the *Borrelia* proteins recited in Table 3. Such antibodies and antibody fragments can be used, for example, in diagnostic and therapeutic methods. The antibody, or antibody fragment, can be any monoclonal or polyclonal antibody that specifically recognize *Borrelia* antigens recited in Table 3. In some embodiments, the present invention provides monoclonal antibodies, or fragments thereof, that specifically bind to *Borrelia* antigens recited in Table 3. In some embodiments, the monoclonal antibodies, or fragments thereof, are chimeric or humanized antibodies. In other embodiments, the monoclonal antibodies, or fragments thereof, are human antibodies.

The antibodies of the present invention find use in experimental, diagnostic and therapeutic methods. In certain embodiments, the antibodies of the present invention are used to detect the presence or absence of *Borrelia* proteins in a sample from a patient.

Polyclonal antibodies can be prepared by any known method. Polyclonal antibodies can be raised by immunizing an animal (e.g. a rabbit, rat, mouse, donkey, etc) by multiple subcutaneous or intraperitoneal injections of the relevant antigen (a purified peptide fragment, full-length recombinant protein, fusion protein, etc., from Table 3) optionally conjugated to keyhole limpet hemocyanin (KLH), serum albumin, etc. diluted in sterile saline and combined with an adjuvant (e.g. Complete or Incomplete Freund's Adjuvant) to form a stable emulsion. The polyclonal antibody is then recovered from blood, ascites and the like, of an animal so immunized. Collected blood is clotted, and the serum decanted, clarified by centrifugation, and assayed for antibody titer. The polyclonal antibodies can be purified from serum or ascites according to standard methods in the art including affinity chromatography, ion-exchange chromatography, gel electrophoresis, dialysis, etc.

Monoclonal antibodies can be prepared using hybridoma methods, such as those described by Kohler and Milstein (1975) Nature 256:495. Using the hybridoma method, a mouse, hamster, or other appropriate host animal, is immunized as described above to elicit the production by lymphocytes of antibodies that will specifically bind to an immunizing antigen. Alternatively, lymphocytes can be immunized in vitro. Following immunization, the lymphocytes are isolated and fused with a suitable myeloma cell line using, for example, polyethylene glycol, to form hybridoma cells that can then be selected away from unfused lymphocytes and myeloma cells. Hybridomas that produce monoclonal antibodies directed specifically against a chosen antigen as determined by immunoprecipitation, immunoblotting, or by an in vitro binding assay such as radioimmunoassay (RIA) or enzyme-linked immunosorbent assay (ELISA) can then be propagated either in vitro culture using standard methods (Goding, Monoclonal Antibodies: Principles and Practice, Academic Press, 1986) or in vivo as ascites tumors in an animal. The monoclonal antibodies can then be purified from the culture medium or ascites fluid as described for polyclonal antibodies above.

Alternatively monoclonal antibodies can also be made using recombinant DNA methods as described in U.S. Pat. No. 4,816,567. The polynucleotides encoding a monoclonal antibody are isolated, such as from mature B-cells or hybridoma cell, such as by RT-PCR using oligonucleotide primers that specifically amplify the genes encoding the heavy and light chains of the antibody, and their sequence is determined using conventional procedures. The isolated polynucleotides encoding the heavy and light chains are then cloned into suitable expression vectors, which when transfected into host cells such as *E. coli* cells, simian COS cells, Chinese hamster ovary (CHO) cells, or myeloma cells that do not otherwise produce immunoglobulin protein, monoclonal antibodies are generated by the host cells. Also, recombinant monoclonal antibodies or fragments thereof of the desired species can be isolated from phage display libraries as described (McCafferty et al., 1990, Nature, 348:552-554; Clackson et al., 1991, Nature, 352:624-628; and Marks et al., 1991, J. Mol. Biol., 222:581-597).

The polynucleotide(s) encoding a monoclonal antibody can further be modified in a number of different manners using recombinant DNA technology to generate alternative antibodies. In one embodiment, the constant domains of the light and heavy chains of, for example, a mouse monoclonal antibody can be substituted 1) for those regions of, for example, a human antibody to generate a chimeric antibody or 2) for a non-immunoglobulin polypeptide to generate a fusion antibody. In other embodiments, the constant regions are truncated or removed to generate the desired antibody fragment of a monoclonal antibody. Furthermore, site-directed or high-density mutagenesis of the variable region can be used to optimize specificity, affinity, etc. of a monoclonal antibody.

In some embodiments, of the present invention the monoclonal antibody against a *Borrelia* antigen from Table 3 is a humanized antibody. Humanized antibodies are antibodies that contain minimal sequences from non-human (e.g., murine) antibodies within the variable regions. Such antibodies are used therapeutically to reduce antigenicity and HAMA (human anti-mouse antibody) responses when administered to a human subject. In practice, humanized antibodies are typically human antibodies with minimum to no non-human sequences. A human antibody is an antibody produced by a human or an antibody having an amino acid sequence corresponding to an antibody produced by a human.

Humanized antibodies can be produced using various techniques known in the art. An antibody can be humanized by substituting the CDR of a human antibody with that of a non-human antibody (e.g. mouse, rat, rabbit, hamster, etc.) having the desired specificity, affinity, and capability (Jones et al., 1986, Nature, 321:522-525; Riechmann et al., 1988, Nature, 332:323-327; Verhoeyen et al., 1988, Science, 239:1534-1536). The humanized antibody can be further modified by the substitution of additional residue either in the Fv framework region and/or within the replaced non-human residues to refine and optimize antibody specificity, affinity, and/or capability.

Human antibodies can be directly prepared using various techniques known in the art. Immortalized human B lymphocytes immunized in vitro or isolated from an immunized individual that produce an antibody directed against a target antigen can be generated (See, for example, Cole et al., Monoclonal Antibodies and Cancer Therapy, Alan R. Liss, p. 77 (1985); Boemer et al., 1991, J. Immunol., 147 (1):86-95; and U.S. Pat. No. 5,750,373). Also, the human antibody can be selected from a phage library, where that phage library expresses human antibodies (Vaughan et al., 1996, Nature Biotechnology, 14:309-314; Sheets et al., 1998, PNAS, 95:6157-6162; Hoogenboom and Winter, 1991, J. Mol. Biol., 227:381; Marks et al., 1991, J. Mol. Biol., 222:581). Humanized antibodies can also be made in transgenic mice containing human immunoglobulin loci that are capable upon immunization of producing the full repertoire of human antibodies in the absence of endogenous immunoglobulin production. This approach is described in U.S. Pat. Nos. 5,545,807; 5,545,806; 5,569,825; 5,625,126; 5,633,425; and 5,661,016.

This invention also encompasses bispecific antibodies. Bispecific antibodies are antibodies that are capable of specifically recognizing and binding at least two different epitopes.

Bispecific antibodies can be intact antibodies or antibody fragments. Techniques for making bispecific antibodies are common in the art (Millstein et al., 1983, Nature 305:537-539; Brennan et al., 1985, Science 229:81; Suresh et al, 1986, Methods in Enzymol. 121:120; Traunecker et al., 1991, EMBO J. 10:3655-3659; Shalaby et al., 1992, J. Exp. Med. 175:217-225; Kostelny et al., 1992, J. Immunol. 148:1547-1553; Gruber et al., 1994, J. Immunol. 152:5368; and U.S. Pat. No. 5,731,168).

In certain embodiments of the invention, it may be desirable to use an antibody fragment, rather than an intact antibody, to increase tumor penetration, for example. Various techniques are known for the production of antibody fragments. Traditionally, these fragments are derived via proteolytic digestion of intact antibodies (for example Morimoto et al., 1993, Journal of Biochemical and Biophysical Methods 24:107-117 and Brennan et al., 1985, Science, 229:81). However, these fragments are now typically produced directly by recombinant host cells as described above. Thus Fab, Fv, and scFv antibody fragments can all be expressed in and secreted from *E. coli* or other host cells, thus allowing the production of large amounts of these fragments. Alternatively, such antibody fragments can be isolated from the antibody phage libraries discussed above. The antibody fragment can also be linear antibodies as described in U.S. Pat. No. 5,641,870, for example, and can be monospecific or bispecific. Other techniques for the production of antibody fragments will be apparent to the skilled practitioner.

It may further be desirable, especially in the case of antibody fragments, to modify an antibody in order to increase its serum half-life. This can be achieved, for example, by incorporation of a salvage receptor binding epitope into the antibody fragment by mutation of the appropriate region in the antibody fragment or by incorporating the epitope into a peptide tag that is then fused to the antibody fragment at either end or in the middle (e.g., by DNA or peptide synthesis).

The present invention further embraces variants and equivalents which are substantially homologous to the chimeric, humanized and human antibodies, or antibody fragments thereof, set forth herein. These can contain, for example, conservative substitution mutations, i.e. the substitution of one or more amino acids by similar amino acids. For example, conservative substitution refers to the substitution of an amino acid with another within the same general class such as, for example, one acidic amino acid with another acidic amino acid, one basic amino acid with another basic amino acid or one neutral amino acid by another neutral amino acid. What is intended by a conservative amino acid substitution is well known in the art.

III. Treatment for Infection

In certain embodiments, after a patient has been diagnosed with *Borrelia* infection, that patient is administered appropriate antibiotics. However, certain patients may be referactory to antibiotic treatment. In such situations, other treatments are employed, such as using antibodies to one or more of the antigens described in Table 3.

In some embodiments, the present invention provides antibodies that proteins from Table 3. Any suitable antibody (e.g., monoclonal, polyclonal, or synthetic) can be utilized in the therapeutic methods disclosed herein. In some embodiments, the antibodies used for therapy are humanized antibodies. Methods for humanizing antibodies are well known in the art (See e.g., U.S. Pat. Nos. 6,180,370, 5,585,089, 6,054,297, and 5,565,332; each of which is herein incorporated by reference).

In some embodiments, the antibody is conjugated to a cytotoxic agent. For certain applications, it is envisioned that the therapeutic agents will be pharmacologic agents that will serve as useful agents for attachment to antibodies, particularly cytotoxic or otherwise anticellular agents having the ability to kill *Borrelia* bacteria. The present invention contemplates the use of any pharmacologic agent that can be conjugated to an antibody, and delivered in active form.

IV. BBK07, BBK12, and BBK19

The present invention provides compositions comprising protein sequences, as well as the DNA sequences encoding them, of three proteins, BBK07, BBK12, and BBK19 ("the proteins"), of the Lyme disease agent *Borrelia burgdorferi* and deduced proteins of other pathogenic *Borrelia* species that are orthologous to these three proteins. In certain embodiments, the present invention provides diagnostic tests for antibodies to *Borrelia burgdorferi* or other pathogenic *Borrelia* species and vaccines for inducing an immune response to *Borrelia burgdorferi* or other pathogenic *Borrelia* species. The proteins had not previously been identified or known to be antigens to which an immune response during infection is directed in humans or other animals. It is believed that the immunogenicity of recombinant forms of these proteins have not been previously determined. An improved diagnostic test for Lyme disease is needed and one or more of the proteins, by themselves or in combination with other recombinant proteins, should provide for better sensitivity and specificity than currently available assays. These proteins have also not previously been investigated as sub-unit vaccines, either by themselves or in combination with other recombinant proteins, for protection against infection by *Borrelia burgdorferi* or other pathogenic *Borrelia* species. As such, in certain embodiments, the present invention provides vaccines using these proteins.

The encoding DNA sequences and the deduced proteins for BBK07, BBK12, and BBK19 were originally identified when the chromosome sequence and most of the plasmid sequences for the B31 strain of *Borrelia burgdorferi* (Bb) were detennined (Fraser et al., Vature, 1997: Casjens et al., Alolecular Microbiology, 2000). They are located on the Ip36 linear plasmid of Bb. We have identified an orthologous DNA sequence to BBK07 in another *Borrelia* species, *Borrelia turicatae* (Bt), a cause of relapsing fever. This DNA sequence and the deduced protein are not been published or deposited in a public database.

The evidence of an orthologous gene in a distantly related species of *Borrelia* as well as Bb indicates the genes for these proteins may occur in the other *Borrelia* species that cause Lyme disease. These include, but are not limited to, *Borrelia afzelii* (Ba) and *Borrelia garinii* (Bg). The chromosomes and the partial plasmid sequences for a single strain each of these species have been published but the deposited sequences do not show evidence of an ortholog of BBK07 and possible not the other genes as well. We would expect to identify orthologs of BBK07, BBK12, and/or BBK 19 in Ba, Bg, and other agents of Lyme disease. In the case of BBK07, this could be done by making an alignment of the Bb and Bt ortholog sequences and design polymerase chain reaction primers on the basis of conserved sequence between the two genes. These primers would then be used to amplify a part of the sought-after gene in these other species. Once the sequence of the resultant cloned DNA was confirmed and characterized, we would use inverse PCR to amplify the 5' and 3' ends of the genes and thereby have the complete gene sequence. Alternatively we could use the closed partial gene fragment as a probe for a DNA library of Ba or Bg in a plasmid, bacteriophage, or other cloning vector. For these methods, one could use low passage isolates of Ba and Bg obtained directly from infected animals or to use field collected ticks that have been documented to contain either Sa or Bg. By the same approach, one could also identify and isolate orthologs of BBK07, BSK12, and BBK19 in other relapsing fever species. including *Borrelia hermsii*.

On the other hand, if the existence of the putative orthologs in Ba and/or Bg cannot be established, it indicates that one or more of these genes and their products are unique to Bb. In this case, a diagnostic test for Lyme disease that was based on detection of antibodies to one or more the proteins would be specific for Bb. Such a test would be very useful in Europe and in Asia where the three species co-occur. Differentiating between infection with Bb or with one of the other species is clinically important because infection with Bb is much more likely to be associated with a chronic form of arthritis.

V. FLiL (BB0279) and FlbB (BB0286)

In certain embodiments, the present invention comprises recombinant proteins of Lyme disease *Borrelia* species flagella-associated proteins FliL and FlbB. In some embodiments, the methods are a diagnostic test for antibodies to either or both FliL and FlbB in a variety of different formats, in which the FliL and/or FlbB are alone or in combination with one or more other recombinant proteins. The diagnostic assay is for antibodies to *Borrelia burgdorferi* or another Lyme disease *Borrelia* species, such as *B. afzelii* and *B. garinii*. This assay may be used for laboratory support of the diagnosis of Lyme disease, for staging the infection, and for assessing the outcome of antibiotic therapy. Related proteins of relapsing *Borrelia* species, the syphilis agent *Treponema pallidum*, and the leptospirosis agent *Leptospira interrogans* could also be used as the basis for diagnostic assays for antibodies against these respective etiologic agents.

We have experimental evidence of the immunogenicity and antigenicity of FliL and FlbB in natural infections of *Borrelia burgdorferi* of humans and the wild mouse *Peromyscus leucopus*. These studies demonstrated that assays based on one or both proteins were specific as well as sensitive. These data were obtained using an array of approximately 80% of the open reading frames of the *Borrelia burgdorferi* genome and sera from Lyme disease patients and controls and from infected and uninfected mice.

Two proteins of the flagellar apparatus of *Borrelia burgdorferi* and related Lyme disease (LD) agents, *B. garinii* and *B. afzeiii*, have been identified as important antigens for the serologic (i.e. antibody-based) diagnosis of LD. These are the FlaB protein, which is the major flagellin of flagella and encoded by the flaB (open reading frame BBO147 of the *B. burgdorferi* genome) gene, and FlgE, which is the hook protein of the flagella apparatus and encoded by the flgE (B80283) gene. There have been several papers demonstrating the importance of the FlaB (formerly known as the "41 kDa" or "p41" protein) for serodiagnosis.

Purified flagella have also been reported as an antigen preparation for a serologic assay for Lyme disease and are the basis of at least one commercial assay (Dako) for antibodies to LD *Borrelia* sp., and a flagella-based assay was used by the Centers for Disease Control for a period as a reference assay for LD diagnosis. These purified flagella would contain FlaB and possibly FlgE but not the components of the export mechanism, such as FIiL.

Since 1983 there have been several papers and other works that have identified antigens according to apparent molecular weight on SDS polyacrylamide gels and Western blots. Included in this group is the FlaB (41 kDa) protein. Examples of other proteins that were first revealed as antigens through Western blots of native proteins were the OspA protein ("31 kDa"), BmpA protein ("39 kDa"), and Decorin-binding Protein A ("18 kDa"). There have also several other proteins that have been identified as antigens of diagnostic importance when they were expressed as recombinant proteins in *E. coli* and then reacted with sera from humans and other animals with infection with a LD *Borrelia* sp. Included in this group is the FlgE protein. While the fliL (BB0279) and flbB (BB0286) genes of *B. burgdorferi* and related species had been identified in sequence analysis of the parts or all of the genome and the polypeptides encoded by the open reading frames deduced, we know of no evidence that they were designated as informative antigens and of diagnostic importance previous to this disclosure. Neither is their evidence that homologous FliL and FlbB proteins of other pathogen spirochetes, including the *Borrelia* species that cause relapsing fever, *Treponema pallidum*, the agent of syphilis, and *Leptospira interrogans*, the agent of leptospirosis, had been previously identified as informative antigens of diagnostic importance for their respective diseases. All three groups of organisms have sequences that are homologous to the fliL gene of *B. burgdorferi* and other LD species. The calculated molecular weight of FIiL is 19929. There are multiple proteins migrating with this apparent size in SDS PAGE gels, and they cannot be distinguished. Although there is experimental evidence that the FIiL protein is expressed in vitro as well as in vivo, and thus would be expected to present in the whole cell lysates in gels and Western blots, the FliL protein may have not previously been recognized as an important antigen because it is present in small amounts and also because it would be predicted to migrate in the gel in an area with many other proteins, which could not be discriminated.

VI. Kits

In yet other embodiments, the present invention provides kits for the detection and characterization of *Borrelia* infection. In some embodiments, the kits contain antibodies specific for one or more of the antigens in Table 3, in addition to detection reagents and buffers. In other embodiments, the kits contain reagents specific for the detection of nucleic acid (e.g., oligonucleotide probes or primers). In some embodiments, the kits contain all of the components necessary and/or sufficient to perform a detection assay, including all controls, directions for performing assays, and any necessary software for analysis and presentation of results.

Another embodiment of the present invention comprises a kit to test for the presence of the polynucleotides or proteins. The kit can comprise, for example, an antibody for detection of a polypeptide or a probe for detection of a polynucleotide. In addition, the kit can comprise a reference or control sample; instructions for processing samples, performing the test and interpreting the results; and buffers and other reagents necessary for performing the test. In other embodiments the kit comprises pairs of primers (e.g., as shown in Table 4) for detecting expression of one or more of the antigens in Table 3.

EXPERIMENTAL

The following examples are provided in order to demonstrate and further illustrate certain preferred embodiments and aspects of the present invention and are not to be construed as limiting the scope thereof.

In the experimental disclosure which follows, the following abbreviations apply: N (normal); M (molar); mM (millimolar); μM (micromolar); mol (moles); mmol (millimoles); μmol (micromoles); nmol (nanomoles); pmol (picomoles); g (grams); mg (milligrams); μg (micrograms); ng (nanograms); l or L (liters); ml (milliliters); μl (microliters); Xg (time gravity); and C (degrees Centigrade).

Example 1

Screening for Lyme Disease Related Antigens

This example describes genome-wide screening using arrays such that all or most open reading frames will be represented and screened without bias toward those expressed in greatest amounts in culture medium.

Materials and Methods

Bacterial strain, genome sequences, and primer design. Strain B31 of *B. burgdorferi* had undergone three passages since its isolation (6, 19). This organism was cultivated in BSK II broth medium (6). A high-passage isolate of strain B31 had been cloned by limiting dilution and had been serially passed in culture medium at least 50 times. Whole-genome DNA was extracted from the low-passage isolate as described previously (62). Primers were based on the sequences and annotations of the chromosome and 21 plasmids of strain B31 (http://www., followed by "blackwellpublishing.com/products/journals/suppmat/mole/casjens.htm") (21, 39). Forward and reverse primers were 20 nucleotides long and were complementary to the 5' and 3' ends of each ORF; peripherally they also included 33 nucleotide adapter sequences specific for plasmid pXT7 for recombination cloning, as described previously (29). The forward and reverse primers for about 200 of the ORFs (that were identified as immunogenic) are provided in Table 4 below:

TABLE 4

| ORF | 5' Primer | SEQ ID NO: | 3' Primer | SEQ ID NO: |
|---|---|---|---|---|
| BB_0056 | ATGTCAATAAAAACAGTAAA | 1 | ATTCTCCAAAACCTTAATAC | 2 |
| BB_0108 | ATGAAGAGTTTTTTATTTTG | 3 | TTTTAGACTAGAATCCAAGA | 4 |
| BB_0147 | ATGATTATCAATCATAATAC | 5 | TCTAAGCAATGACAAAACAT | 6 |
| BB_0181 | GTGGATTCAACATTTTCAGG | 7 | TACTCCCATTTTATTTATTA | 8 |
| BB_0215 | TTGATGAAAAAAGTTATTAT | 9 | TGTTTTTATCCCTAAAAAGC | 10 |
| BB_0238 | GTGTTAATGGAGGTTCTTAT | 11 | ATTTATGGAAGACAAAAACC | 12 |
| BB_0260 | TTGAAAGGGTTTTTAGCGAT | 13 | AACATATTGATCTTTTTCAT | 14 |
| BB_0279 | ATGCCTAATAAAGACGATGA | 15 | CATATCAAAAATATCAATTT | 16 |

TABLE 4-continued

| ORF | 5' Primer | SEQ ID NO: | 3' Primer | SEQ ID NO: |
|---|---|---|---|---|
| BB_0283 | ATGATGAGGTCTTTATATTC | 17 | ATTTTTCAATCTTACAAGTT | 18 |
| BB_0286 | ATGAAAGTGAATAATTTTTT | 19 | CTCCAATGAACTAACAGACA | 20 |
| BB_0323 | ATGAATATAAAGAATAAATT | 21 | TTTGGCAGGAATTATTATCT | 22 |
| BB_0328 | ATGAAATATATAAAAATAGC | 23 | TTTTTTAGTTTTAATATCTT | 24 |
| BB_0329 | ATGAAATTACAAAGGTCATT | 25 | TTTATTTTTAATTTTAGCT | 26 |
| BB_0337 | ATGGGTTTTCACATTTATGA | 27 | TTTTTGTTTAATAGAATAAA | 28 |
| BB_0348 | ATGATTTCAAAGTTAACAAA | 29 | TATATTTCGTCCTTTGATTG | 30 |
| BB_0359 | ATGAAAATAAATTTTTAAT | 31 | ATTACCTAATTTAGACAAAT | 32 |
| BB_0365 | ATGTATAAAAATGGTTTTTT | 33 | ATTCGTTAACATAGGTGAAA | 34 |
| BB_0385 | ATGTTAAAAAAGTTTATTA | 35 | ATTTTCCATTTGCAAAACAA | 36 |
| BB_0408 | ATGTTTTTAATTTTTTGAA | 37 | TTCAGATTCCTTTAATTTTA | 38 |
| BB_0476 | ATGAAATTTAGGAGGTTAGT | 39 | TTCCAATATCTCAAGAATTC | 40 |
| BB_0518 | ATGGGCAAAATAATAGGTAT | 41 | TTTTTTATCCTCGTCAACAA | 42 |
| BB_0543 | TTGTATATGATTAGGCTTAA | 43 | CACAATTCCAAATTCAAAAC | 44 |
| BB_0603 | ATGAAAAGCCATATTTTATA | 45 | GCTTCCGCTGTAGGCTATTT | 46 |
| BB_0649 | ATGGCTAAAGACATATATTT | 47 | CATCATTCCCATTCCTGGGT | 48 |
| BB_0652 | ATGAAAAAAGGATCTAAGCT | 49 | ATTACTCTTTGCATATTTTG | 50 |
| BB_0668 | TTGGTTTACATGAAAAGGAA | 51 | ATTTTTCGGAGATGATTCTT | 52 |
| BB_0681 | GTGGTTAGTATGAAGCTTAA | 53 | CTTTTCGATCTTAAAATAAT | 54 |
| BB_0751 | TTGGACTTGTTAGATTTACT | 55 | ATCTGCATTGTTGTGATGTT | 56 |
| BB_0772 | ATGAACAAACTAATGTTGAT | 57 | ATTTTGGTTTCCATCAATTT | 58 |
| BB_0774 | ATGATGAGAGCATTATGGAC | 59 | TTGCCTTTTTAAGTTATTTG | 60 |
| BB_0805 | TTGAGGAAAATATTAAAGTT | 61 | ATAATCTTTATCTCTAACAA | 62 |
| BB_0811 | ATGAAATACTTTTATTTTTT | 63 | ATAATCTTTTAAAAGCATTT | 64 |
| BB_0844 | ATGAAAAAAAAAAATTTATC | 65 | TTTACTCGTCTCTAAAAAAT | 66 |
| BB_A03 | TTGAAAAAAACGATTATTGT | 67 | TATAGTGTCTTTAAGTTTAT | 68 |
| BB_A04 | TTGAAAAGAGTCATTGTATC | 69 | GTTAATTAACGAATTAAATG | 70 |
| BB_A07 | GTGTGTGGGAGACGTATGAA | 71 | AAACGAAGCAGATGCATCAT | 72 |
| BB_A15 | ATGAAAAAATATTTATTGGG | 73 | TTTTAAAGCGTTTTTAATTT | 74 |
| BB_A16 | ATGAGATTATTAATAGGATT | 75 | TTTTAAAGCGTTTTTAAGCT | 76 |
| BB_A19 | ATGACGGCTTTACTTGAACG | 77 | CTTTTGTCTCTTTTTTATCC | 78 |
| BB_A25 | ATGAAAATTGGAAAGCTAAA | 79 | TTTCTTTTTTTGCTTTTAT | 80 |
| BB_A34 | ATGATAATAAAAAAAGAGG | 81 | TTCTTCTATAGGTTTTATTT | 82 |
| BB_A36 | TTGATGCAAAGGATAAGTAT | 83 | AACATTTCCATAATTTTTCA | 84 |
| BB_A40 | ATGAGCGATTCAATTGATTT | 85 | AATTGAATCTTTTATTTGCT | 86 |
| BB_A48 | ATGAGATACAAGTTAAAAAT | 87 | TTCATTGCTACCTTCTTGCA | 88 |
| BB_A57 | TTGAACGGCAAGCTTAGAAA | 89 | TTGATAATTTTTTTCTACCA | 90 |
| BB_A64 | TTGAAGGATAACATTTTGAA | 91 | CTGAATTGGAGCAAGAATAT | 92 |

TABLE 4-continued

| ORF | 5' Primer | SEQ ID NO: | 3' Primer | SEQ ID NO: |
|---|---|---|---|---|
| BB_A66 | TTGAAAATCAAACCATTAAT | 93 | CATTATACTAATGTATGCTT | 94 |
| BB_B09 | ATGAAATACCTTAAAAACAT | 95 | AAATTTATGCCTACTTGATT | 96 |
| BB_B14 | ATGATATTATATCAAAATCA | 97 | ACTTTTATAATCTTTATTTT | 98 |
| BB_B16 | ATGAAAATATTGATAAAAAA | 99 | TTTAATTGGTTTTATTTCAG | 100 |
| BB_B19 | ATGAAAAAGAATACATTAAG | 101 | AGGTTTTTTTGGACTTTCTG | 102 |
| BB_C03 | ATGGAAAAAAACGTGTTGT | 103 | GATTTTTAGTTCTTCATATT | 104 |
| BB_C06 | ATGAGAAAAATAAGCCTATT | 105 | ATCTTTAGGCAAGTCTGCCA | 106 |
| BB_C10 | ATGCAAAAAATAAACATAGC | 107 | ATCTTCTTCAAGATATTTTA | 108 |
| BB_E09 | ATGCAAAAAGACATATATAT | 109 | TTCATCAATAAAAAGTTTTA | 110 |
| BB_F03 | TTGAGTATGGAACAACTAAT | 111 | CTTGAAATAGTTGCCAATTA | 112 |
| BB_G18 | ATGGCAGATTTCGATTTTAC | 113 | TGCAAATTTTCTGTTACCAT | 114 |
| BB_G33 | ATGAAATCATCAGTAGTGAC | 115 | TTTGAAATAATTGCTAATTA | 116 |
| BB_H06 | ATGAAAAAAAGTTTTTTATC | 117 | TAATAAAGTTTGCTTAATAG | 118 |
| BB_H13 | ATGAAAGCAGTTTTGGCAAC | 119 | TTTAAAAAATTTAGCAATTA | 120 |
| BB_I42 | ATGAGGATTTTGGTTGGCGT | 121 | TGTAGGTAAAATAGGAACTG | 122 |
| BB_J24 | ATGTTAAGGGCATTGTTAAT | 123 | GTAGTAGAAAGAATTGCCCT | 124 |
| BB_K07 | ATGAGTAAACTAATATTGGC | 125 | ATTATTAAAGCACAAATGTA | 126 |
| BB_K12 | ATGAGTAAACTAATATTGGC | 127 | GCTTAAAGTTGTCAATGTTT | 128 |
| BB_K13 | TTGCTTTTAGGAGGTCAATC | 129 | ATCCAATAATAAGAAACGG | 130 |
| BB_K19 | TTGAAAAATATATTATCAA | 131 | ATTGTTAGGTTTTTCTTTTC | 132 |
| BB_K23 | ATGAAAGCCGTTATACCTAG | 133 | CTCAAATTTCAATCCCTTTG | 134 |
| BB_K32 | ATGAAAAAAGTTAAAAGTAA | 135 | GTACCAAACGCCATTCTTGT | 136 |
| BB_K52 | ATGAAAAAGAACATATATAT | 137 | TTCATCAGTAAAAAGTTTTA | 138 |
| BB_K53 | ATGAGGATTTTGGTTGGCGT | 139 | TGTAGGTAAAATAGAAACTG | 140 |
| BB_L03 | ATGAGTGATATAACAAAAAT | 141 | CCCTTTTATTGCTCTATTCC | 142 |
| BB_L27 | GTGTATAATATGACTATAAG | 143 | TTTGGAAATAAAAGCAAATA | 144 |
| BB_L39 | ATGGAGAAATTTATGAATAA | 145 | TTTTAAATTTCTTTTAAGCT | 146 |
| BB_L40 | ATGAATAAAAAAACAATTAT | 147 | ATCTTCTTCATCATAATTAT | 148 |
| BB_M27 | ATGAGAAATAAAAACATATT | 149 | ATTAGTGCCCTCTTCGAGGA | 150 |
| BB_M34 | ATGAACAATTTAGCATACAA | 151 | ATTTAAAAAATACTTATTGA | 152 |
| BB_M36 | ATGCTTATTAATAAAATAAA | 153 | CTTTAGTCTAAATATGCGCT | 154 |
| BB_N11 | TTGCCGCAAGATACAATTAG | 155 | AACTATATCTTGAGTAGTAA | 156 |
| BB_N27 | GTGTATAATATGACCATAAG | 157 | TTTAGAAATGAAAGCAAATA | 158 |
| BB_N28 | ATGAAAATTATCAACATATT | 159 | TTGCTGAGCTTGGCAGGTAC | 160 |
| BB_N34 | ATGAGAAATTTGGTGCACAG | 161 | ATTTAAAAAATGCTTATTGA | 162 |
| BB_N38 | ATGAATAAGAAAATGAAAAT | 163 | TTTTAAATTTTTTTTAAGCA | 164 |
| BB_N39 | ATGAATAAAAAAACATTGAT | 165 | CTGACTGTCACTGATGTATC | 166 |
| BB_O34 | ATGACTAATTTAGCGTACAG | 167 | ATTAAAGAAATACTTATTAA | 168 |

TABLE 4-continued

| ORF | 5' Primer | SEQ ID NO: | 3' Primer | SEQ ID NO: |
|---|---|---|---|---|
| BB_O39 | ATGAATAAGAAAATGAAAAT | 169 | TTCTTTTTTATCTTCTTCTA | 170 |
| BB_O40 | ATGAATAAAAAAATATTGAT | 171 | ATATGAATTACTATCCTCAA | 172 |
| BB_P34 | ATGACTAATTTAGCGTACAA | 173 | TTTGATATATTGTAAATATC | 174 |
| BB_P39 | ATGAATAAAAAAACAATTAT | 175 | ATCTTCTTCATCATAATTAT | 176 |
| BB_Q03 | ATGAGGATTTTGGTTGGCGT | 177 | TAAAATTTTTCCATTAATTG | 178 |
| BB_Q04 | ATGAAAAAGAACATATGTAT | 179 | TTCATCAGTAAAAAGTTTTA | 180 |
| BB_Q13 | TTGGGAGGATTTAATATGGA | 181 | ACTTTGTTTGATATGTACTT | 182 |
| BB_Q19 | GTGCTTAAAAGGGGGGCTAA | 183 | AGTGTTGTTTGGTTTAGTTT | 184 |
| BB_Q34 | ATGACCATAAGGGAAAATTT | 185 | TTTAGAAATGAAAGCAAATA | 186 |
| BB_Q35 | ATGAAAATCATCAACATATT | 187 | GTTTTGCCAATTAGCTGTAA | 188 |
| BB_Q40 | ATGGATAATAAAAAACCTAA | 189 | TTTAACATATTCATCATATA | 190 |
| BB_Q42 | ATGAATAGTTTGACTTACAG | 191 | TTTGCCACCTTGTAAATATT | 192 |
| BB_R12 | ATGCAATTTTATGATTTAAG | 193 | AGTGTTGTTTGGTTTAGATT | 194 |
| BB_R35 | ATGAGTAATTTAGCCTACAA | 195 | ATTGAAAAAACACTTATTAA | 196 |
| BB_R42 | ATGAATAAAAAAATAAAAAT | 197 | TTCTTTTTTACCTTCTACAG | 198 |
| BB_S30 | ATGAAAATCATCAACATATT | 199 | GCCACCATTATTGCAGTTAC | 200 |
| BB_S41 | ATGAATAAGAAAATGAAAAA | 201 | TTTTTTATCTTCTATATTTT | 202 |

Also included was the type K OspC protein gene of strain 297, in addition to the type A OspC gene of B31 (12, 15). ORFs were named according to the designations assigned to strain B31's genome (21, 39); "BB" followed by a four digit number (e.g., BB0279) indicates a chromosome ORF, while "BB" followed by a third letter and a two-digit number (e.g., BBA25) indicates a linear or circular plasmid ORF, and each replicon is assigned a separate letter (e.g., "A" for linear plasmid lp54 or "B" for circular plasmid cp26). As needed, genome ORF designations were supplemented with names in common use or when polypeptide identity has been inferred from homology to proteins with known functions. The predictions of lipoproteins are those of Casjens et al. (http://www. followed by "blackwellpublishing.com/products/journals/suppmat/mole/casjens.htm").

Array production. PCR amplification, cloning of amplicons into the plasmid vector, and then transformation of *E. coli* DH5 were carried out as described previously (29, 86). Of the 1,640 ORFs that were identified in the *B. burgdorferi* strain B31 genome (21, 39), 1,513 (861 chromosomal genes and 652 plasmid genes) were subjected to PCR with the specific primers. The remaining 127 ORFs had sequences that were so similar to the sequence of at least one other ORF that PCR primers would not distinguish between them. Of the 861 chromosomal ORFs that were attempted to be amplified, 783 (91%) produced a product that was the correct size when PCR was performed, and 756 (88%) were successfully cloned into the vector. Of the 652 plasmid ORFs, 572 (88%) were amplified, and 536 (82%) were cloned into the plasmid vector. A sample consisting of 7% of 1,292 clones from strain B31 was randomly selected for sequencing, and the insert was confirmed in all cases. The coefficient of determination (R2) between the sizes of the ORFs and cloning success was only 0.05. The following 26 plasmid ORFs were randomly selected to be replicated on the array: BBA03, BBA04, BBA14, BBA25, BBA52, BBA59, BBA62, BBA69, BBB07, BBB19, BBC06, BBJ50, BBK50, BBL28, BBL39, BBM38, BBN37, BBO40, BBP28, BBQ35, BBQ60, BBQ80, BBR28, BBR42, BBS30, and BBT07. As a negative control, the arrays also contained 14 pairs of spots with the *E. coli* coupled transcription-translation reaction mixture without plasmid DNA.

Plasmid DNA was extracted and isolated using QIAprep spin kits (Qiagen). In vitro coupled transcription-translation reactions were performed with RTS 100 *E. coli* HY kits (Roche) in 0.2-ml tubes that were incubated for 5 h at 30° C. The presence of the polyhistidine tag at the N terminus of the recombinant protein and the presence of the influenza A hemagglutinin at the protein's C terminus were detected with monoclonal antibodies His-1 (Sigma) and 3F10 (Roche), respectively, and confirmed expression in the in vitro reactions. Products of transcription-translation reactions were printed in duplicate on nitrocellulose-coated glass slides (FAST; Whatman) using an Omni Grid 100 apparatus (Genomic Solutions).

Protein purification. Plasmid DNA was extracted from selected clones and transformed in *E. coli* BL21 Star(DE3)/ pLysS cells as described by the manufacturer (Invitrogen). The resultant transformants were cultivated in Terrific broth (Bio 101 Systems) to stationary phase and, after harvesting by centrifugation, were lysed with BugBuster buffer (Novagen). The lysate was applied to a 5-ml HiTrap chelating HP affinity column (GE Healthcare). After the column was washed, bound proteins were eluted with an imidazole step gradient using an Amersham Biosciences ÄKTA fast protein liquid chromatography system operated with UNICORN 5.01 software. The average amount recovered from a 1.0-liter culture was 1 to 3 mg of protein with a purity of 80 to 90%, as estimated by sodium dodecyl sulfate-polyacrylamide gel electrophoresis. Recovered proteins were printed on array slides, as described above, or subjected to polyacrylamide gel electrophoresis with a 4 to 15% acrylamide gradient and then transferred to nitrocellulose membranes for Western blot analysis (20). For printing on the array, the protein concentrations were 0.03, 0.1, 0.3, and 0.9 mg/ml.

Serum samples. All serum samples were originally collected for other studies for which informed consent had been obtained; patient identifier information had been removed. Serum panel 1 included samples from 48 adults collected between 1990 and 1994, including 24 patients with erythema migrans (early infection), 19 patients with dissemination to other organs or other evidence of persistent infection (later infection), and 5 healthy controls from a region where the organism is not endemic. These samples were provided by the Centers for Disease Control and Prevention, Fort Collins, Colo., which had performed flagellin-based ELISA and IgG and IgM Western blot assays, as described previously (17, 50). Panel 1 also included sera from 13 healthy adult volunteers residing in California.

Serum panel 2 included serum specimens from 20 healthy adult control subjects, 20 adult patients with culture-positive erythema migrans (early infection), and 20 individuals with persistent LB with oliogoarticular arthritis (later infection). All 40 patients with Lyme disease met the criteria of the Centers for Disease Control and Prevention for diagnosis of Lyme disease (95). The 20 patients with erythema migrans were a random sample of 93 patients, seen in a study of early LB, from whom *B. burgdorferi* was cultured from erythema migrans skin lesions (84, 93). Only convalescent samples, which were obtained at the conclusion of 3 to 4 weeks of antibiotic therapy, were tested for these patients, because seropositivity is more frequent during convalescence than during acute infection. The 20 patients with Lyme arthritis were seen in 2006 and early 2007 in a study of susceptibility to Lyme arthritis (82). For 10 of the 20 patients with Lyme arthritis there was resolution of arthritis with antibiotic therapy (antibiotic-responsive arthritis), and for 10 there was not resolution (antibiotic-refractory arthritis). The samples were obtained when the patients had active arthritis. All serum samples had been kept frozen at −80° C. until use.

Sera from 10 white-footed mice (*P. leucopus*), which had been captured and then released after blood samples had been obtained at a field site in Connecticut under an approved animal use protocol, were seropositive as determined by a whole-cell ELISA and a Western blot assay, as described previously (18). These sera were compared with sera from four adult laboratory-reared *P. leucopus* mice that were obtained from the Peromyscus Stock Center, University of South Carolina, and were seronegative as determined by the same assays.

Mouse immunization. Female, 4-week-old BALB/c mice (Jackson) were inoculated intraperitoneally with 10 μg purified protein in phosphate-buffered saline (PBS) or PBS alone emulsified with Freund's complete adjuvant and were boosted twice at 2-week intervals with the antigen solution or PBS alone in incomplete Freund's adjuvant. Plasma samples were collected before each immunization and after the final boost using the Microvette CB 300 system for capillary blood collection (Sarstedt).

Antibody reactions and assays. For experiments with arrays, human sera were diluted 1:200 in protein array blocking buffer (Whatman) that was supplemented with a lysate of *E. coli* at a final protein concentration 5 mg/ml and then were incubated at room temperature for 30 min with constant mixing (29). The arrays were rehydrated in blocking buffer for 30 min, incubated with the pretreated sera for 12 h at 4° C. with constant agitation, washed in 10 mM Tris (pH 8.0)-150 mM NaCl containing 0.05% Tween 20 buffer, and then incubated with biotin-conjugated goat anti-human IgG (Fc-fragment-specific) serum (Jackson ImmunoResearch) that was diluted 1:200 in blocking buffer. After the array slides were washed in 10 mM Tris (pH 8.0)-150 mM NaCl, bound antibodies were detected with streptavidin conjugated with the dye PBXL-3 (Martek). The washed and air-dried slides were scanned with a Perkin Elmer ScanArray Express HT apparatus at a wavelength of 670 nm and with an output of RGB format TIFF files that were quantitated using ProScanArray Express software (PerkinElmer) with correction for spot-specific background. When *P. leucopus* serum was used, it was diluted 1:200 in protein blocking buffer, and alkaline phosphatase-labeled goat anti-*P. leucopus* IgG antiserum (Kirkegaard and Perry) was used as the secondary antibody. Bound antibodies were detected using one-step nitroblue tetrazolium—5-bromo-4-chloro-3-indolylphosphate (BCIP) (Pierce). Arrays were scanned at 2,400 dpi (Hewlett-Packard ScanJet 8200 scanner), and after images were converted to gray scale format and inverted, they were quantitated as described above. Western blot analyses of whole lysates of *B. burgdorferi* using 10 μg protein per lane or 250 ng purified protein per lane were carried out as described previously (10). Nitrocellulose membranes were incubated with human or mouse serum at a dilution of 1:250, and bound antibodies were detected by incubation with alkaline phosphatase-labeled goat anti-human IgG antiserum or anti-mouse IgG antiserum (Jackson ImmunoResearch) at a dilution of 1:1,000. The murine monoclonal IgG antibodies to OspA (BBA15) and FlaB (BB0147) used were H5332 and H9724, respectively (9, 10).

Data analysis. The raw values from array scans were the mean average intensities of all the pixels in a pair of printed spots for each Orf or negative control; these raw values were then log transformed. A preliminary analysis showed that there was no difference in interpretation whether or not the mean value for DNA controls was subtracted from each raw value before log transformation, and, consequently, this additional step was not included.

The following analyses were carried out. (i) The mean and standard deviation (SD) for each Orf with all control serum samples in each panel were determined. For each Orf and for each serum sample, the number of SDs above or below the mean for the control sera in the same serum panel for the Orf in question was determined. For each sample all the Orfs that had array spots with values that were 2 or 3 SDs above the mean for the negative controls in the experiment for the given Orf were tabulated and summed. The frequencies of each Orf that appeared in this cumulative list were then determined. (ii) Bayesian microarray expression analysis and discriminatory antigen selection were performed with software adapted from Cyber-T for protein arrays (4, 86, 87). The correction of Hochberg and Benjamini was applied to control for false discoveries under the multiple test conditions (47). (iii) Cluster analyses were performed and graphic displays of array results were generated using the MultiExperiment Viewer v 4.0 software available from The Institute for Genomic Research (78). The Euclidian distance criterion with average linkage was used, and 1,000 bootstrap analyses with replacement iterations were carried out. (iv) Receiver operating characteristic curves were generated for selected sets of Orfs using the packages "e1071" and "ROCK" in the R statistical environment, available at the http://www. followed by "R-project.org" website. (v) Standard asymptotic or exact statistical analyses of continuous data were carried out with the SYSTAT version 11 (SYSTAT Software, Inc.) software, the StatExact version 6 (Cytel Software Corporation) software, or Confidence Interval Analysis version 2.1.2 (2), available at the http://www. followed by "som.soton.ac.uk/cia" website. Unless noted otherwise, significance tests were two sided. For means, differences, and odds ratios (OR), 95% confidence intervals are indicated below.

Results

Proteome array and overall binding of antibodies. The array comprised in vitro products of 1,292 ORFs of strain B31 and an additional ospC allele from another strain for a total of 1,293 *B. burgdorferi* ORFs. In separate experiments array slides were incubated with samples of serum panels 1 and 2. A serum specimen from a patient with early LB in panel 1 was replicated in the same experiment. The Pearson and Spearman correlation coefficients were 0.94 and 0.87, respectively, for paired log-transformed raw intensity values; the mean log 10 difference between the replicates of this serum was only 0.07 (95% confidence interval, 0.06 to 0.08) for the total set of 1,293 ORFs. For the replicates of the 26 Orfs on the array, the Pearson and Spearman correlation coefficients were 0.84 and 0.84, respectively, for panel 1 and 0.81 and 0.83, respectively, for panel 2. The corresponding mean $\log_{in}$ differences were 0.07 (95% confidence interval, 0.00 to 0.15) and 0.04 (95% confidence interval, −0.03 to 0.11) for the two panels.

FIG. 1 provides an overall summary of the data obtained by pairwise plotting of log-transformed values for each ORF for the three clinical groups of each serum panel (controls, early infection, and later infection). This figure includes the distributions for each group as a whole, as well as medians for the distributions and the results of a nonparametric analysis of the paired data. With infection and its advance, medians shifted slightly to the right in the distributions of average intensities per ORF by clinical group. More notable were the longer right-handed tails of the distributions, which are also reflected by the several outlying points in the scatter plots for patient sera versus controls and for late-infection sera versus early-infection sera. The two panels differed in whether early-infection sera could be distinguished from late-infection sera by a nonparametric statistic (FIG. 1).

The analysis described above first averaged ORF values across clinical groups and then examined correlations for each of the 1,293 ORFs. If, instead, average ORF intensities by serum sample for all 1,293 ORFs were calculated first and then the averages by serum were compared by clinical stage, heterogeneity of the results for individual sera was observed as overlapping distributions for controls and patient groups. For the first serum panel the mean differences in raw intensity values between patient sera and controls were 42 (95% confidence interval, −135 to 218) for early infection and 157 (95% confidence interval, −3 to 318) for later infection; the corresponding differences from controls for panel 2 were −36 (95% confidence interval, −220 to 149) for early infection and 8 (95% confidence interval, −185 to 202) for patients with Lyme arthritis. Thus, the total amount of antibody binding to the array, which is analogous to a whole-cell assay, could not be used to assign sera to infection and control bins with confidence. More promising for this purpose was the smaller number of ORFs populating the long tail in the distributions and the "outliers" in the plots shown in FIG. 1.

By using pairwise comparisons of all sera for individual ORFs, it was estimated that the upper of limit of the number of strain B31 Orfs that were informative as immunogens was 200 of the 1,292 Orfs on the array (see below). To identify these immunogens, two complementary approaches were used. The first approach was based on an often-used criterion for setting a "cutoff" between interpretations of positive and negative for serological assays, namely, values that were 3 SDs above the average for control sera in the same run. Before using this approach, it was first determined whether variances were out-of-proportion high when the mean values for control specimens increased. This would have been reflected in a significant increase in the coefficient of variation (CV) (i.e., SD divided by the mean) as the mean increased. For the 1,292 B31 Orfs and the panel 1 control sera, the mean CV was 0.115 (95% confidence interval, 0.113 to 0.117), and there was little correlation (R=0.06) between the mean and the CV over the range of means. Inasmuch as the SDs for the control sera were the same in both experiments (namely, 0.85 for the 18 control sera in panel 1 and 0.84 for the 20 control sera in panel 2), normalizing the data in units of SDs allowed the data sets to be combined for the two panels. Using a simulation procedure (see below), we found that for the combined set of the later LB panel 1 and 2 sera, ORF values that exceeded the cutoff at a frequency of 6 or more times, out of a possible 39, were unlikely by chance at a one-tailed level of confidence of 0.025.

The log-normalized data for later LB sera and controls of both panels were also examined using a Bayesian statistical procedure (4), using software originally developed for DNA microarray analysis and then modified for antibody binding to proteome arrays (86, 87). For each ORF, an analysis of variance (ANOVA) comparing control sera with later LB sera was performed. In this analysis, the empirical sample variances are replaced with Bayes-regularized variance estimates. The Bayes-regularized variance is obtained by incorporating both the empirical sample variance and the variance of proteins with similar intensity levels (3, 4). This analysis produced F scores and P values that were used to rank the ORFs. The $\log_{10}$ of the F score correlated with the frequencies based on a cutoff of 3 SDs (R2=0.73 as determined by linear regression).

Identification of immunogens. The most informative of the 200 immunogenic Orfs were then identified. Table 1 lists in alphabetical and numerical order the 84 Orfs whose values were 3 SDs above the control values 6 or more times out of a possible 39, had F scores of >11, and had corrected P values of <0.001. The Orfs with the highest frequencies of values that were 3 SDs above the control values were BBG33, BB0279, BBL27, and BBA25. An additional 19 Orfs, for a total of 103 (8.0%) out of 1,292 Orfs, had P values of <5×10-4 as determined by the Bayes-regularized analysis. This additional group included VlsE (BBF33) and the chaperonin GroEL (BB0649). The mean numbers of amino acids were 293 (95% confidence interval, 266 to 320) for the 103 Orfs on the list, compared to 260 (95% confidence interval, 248 to 272) for the other 1,190 Orfs (P=0.11, t test). Thus, immunogenicity was not associated with length of the protein. Moreover, there was no difference between the two groups of Orfs in terms of the amount of protein on the array, as measured by the raw values for antibody binding to the hemagglutinin moiety of the recombinant proteins; the values were 2,816 (95% confidence interval, 2,369 to 3,349) for the 103 Orfs and 2,618 (95% confidence interval, 2,493 to 2,750) for the other Orfs (P=0.42).

TABLE 1

Immunogenic proteins of *B. burgdorferi* in natural infections of humans and mice

| ORF[a] | Later Lyme disease (n = 39)[b] | F score[c] | P value[d] | Early Lyme disease (n = 44)[e] | Mice (n = 10)[f] | PF | Predicted to be lipoprotein[g] | Deduced gene product[h] |
|---|---|---|---|---|---|---|---|---|
| BB0056 | 12 | 18.7 | 6.0E−04 | 4 (5) | 0 | | − | Phosphoglycerate kinase |
| BB0108 | 9 | 18.1 | 7.9E−04 | 1 (2) | 0 | | − | Peptidylprolyl isomerase |
| BB0147 | 17 | 80.7 | 4.8E−12 | 5 (17) | 4 | | − | Flagellar filament (FlaB) |
| BB0181 | 2 | 27.1 | 2.6E−05 | 1 (3) | 0 | | − | Flagellar hook-associated protein (FlgK) |
| BB0215 | 10 | 55.3 | 3.3E−09 | 2 (7) | 3 | | + | Phosphate ABC transporter (PstS) |
| BB0238 | 7 | 33.8 | 2.5E−06 | 2 (3) | 0 | | − | Hypothetical protein |
| BB0260 | 5 | 19 | 5.4E−04 | 3 (4) | 2 | | − | Hypothetical protein |
| BB0279 | 34 | 246.9 | 0 | 10 (16) | 7 | | − | Flagellar protein (FliL) |
| BB0283 | 32 | 149.4 | 0 | 2 (3) | 1 | | − | Flagellar hook protein (FlgE) |
| BB0286 | 0 | 29.4 | 1.2E−05 | 0 (1) | 7 | | − | Flagellar protein (FlbB) |
| BB0323 | 9 | 39.8 | 3.3E−07 | 1 (2) | 2 | | + | Hypothetical protein |
| BB0328 | 2 | 27 | 2.7E−05 | 0 (1) | 0 | 37 | + | Oligopeptide ABC transporter (OppA-1) |
| BB0329 | 30 | 192.2 | 0 | 7 (9) | 0 | 37 | + | Oligopeptide ABC transporter (OppA-2) |
| BB0337 | 5 | 17 | 1.2E−03 | 0 (0) | 0 | | − | Enolase |
| BB0348 | 14 | 59.5 | 1.1E−09 | 1 (6) | 1 | | − | Pyruvate kinase |
| BB0359 | 15 | 50.3 | 1.3E−08 | 1 (2) | 0 | | − | Carboxy-terminal protease |
| BB0365 | 15 | 43.8 | 9.9E−08 | 4 (8) | 4 | | + | Lipoprotein LA7 |
| BB0385 | 6 | 29.3 | 1.2E−05 | 2 (3) | 2 | | + | Basic membrane protein D (BmpD) |
| BB0408 | 16 | 32 | 4.7E−06 | 0 (4) | 4 | | − | Phosphotransferase system, fructose-specific IIABC |
| BB0476 | 7 | 19.9 | 3.9E−04 | 0 (2) | 1 | | − | Translation elongation factor TU (Tuf) |
| BB0518 | 17 | 62.7 | 4.7E−10 | 3 (5) | 2 | | − | Molecular chaperone (DnaK) |
| BB0543 | 7 | 45.2 | 6.4E−08 | 2 (3) | 2 | | − | Hypothetical protein |
| BB0603 | 11 | 54.7 | 3.9E−09 | 3 (10) | 3 | | − | P66 outer membrane protein |
| BB0649 | 1 | 20.8 | 2.7E−04 | 0 (3) | 1 | | − | Chaperonin (GroEL) |
| BB0652 | 5 | 16.6 | 1.4E−03 | 2 (2) | 0 | | − | Protein export protein (SecD) |
| BB0668 | 6 | 21.7 | 1.9E−04 | 1 (3) | 1 | | − | Flagellar filament outer layer protein (FlaA) |
| BB0681 | 8 | 36.2 | 1.1E−06 | 1 (4) | 2 | | − | Methyl-accepting chemotaxis protein |
| BB0751 | 6 | 24.6 | 6.5E−05 | 0 (1) | 1 | | − | Hypothetical protein |
| BB0772 | 6 | 14.8 | 2.9E−03 | 1 (2) | 0 | | − | Flagellar P-ring protein (FlgI) |
| BB0774 | 11 | 44.6 | 7.8E−08 | 1 (1) | 2 | | − | Flagellar basal body cord protein (FlgG) |
| BB0805 | 6 | 13.2 | 5.5E−03 | 0 (2) | 1 | | − | Polyribonucleotidyltransferase (PnpA) |
| BB0811 | 9 | 20.4 | 3.1E−04 | 2 (4) | 0 | | − | Hypothetical protein (COG1413) |
| BB0844 | 7 | 43.1 | 1.2E−07 | 0 (2) | 10 | 12 | + | Hypothetical protein |
| BBA03 | 13 | 35.3 | 1.5E−06 | 1 (4) | 3 | | + | Hypothetical protein |
| BBA04 | 7 | 12.5 | 7.1E−03 | 0 (1) | 3 | 44 | + | "S2 antigen" |
| BBA07 | 17 | 40.6 | 2.7E−07 | 1 (4) | 0 | | + | Hypothetical protein |
| BBA15 | 16 | 28.3 | 1.7E−05 | 3 (6) | 2 | 53 | + | Outer surface protein A |
| BBA16 | 22 | 58 | 1.6E−09 | 1 (2) | 0 | 53 | + | Outer surface protein B |
| BBA19 | 1 | 22 | 1.7E−04 | 1 (3) | 3 | 50 | − | Hypothetical protein |
| BBA25 | 33 | 134.5 | 0 | 23 (27) | 10 | 74 | + | Decorin binding protein B |
| BBA34 | 13 | 76.6 | 1.3E−11 | 1 (2) | 0 | 37 | + | Oligopeptide ABC transporter (OppA-5) |
| BBA36 | 20 | 52.2 | 8.0E−09 | 5 (7) | 7 | | + | Hypothetical protein |
| BBA40 | 10 | 17.2 | 1.1E−03 | 1 (1) | 1 | 148 | − | Hypothetical protein |
| BBA48 | 5 | 33.4 | 2.8E−06 | 1 (3) | 0 | 154 | − | Hypothetical protein |
| BBA57 | 9 | 39.9 | 3.3E−07 | 2 (6) | 9 | | + | Hypothetical protein |
| BBA64 | 14 | 75.6 | 1.6E−11 | 6 (14) | 7 | 54 | + | Hypothetical protein |
| BBA66 | 7 | 34.4 | 2.0E−06 | 4 (6) | 0 | 54 | + | Hypothetical protein |
| BBB09 | 14 | 34.7 | 1.9E−06 | 0 (0) | 2 | | + | Hypothetical protein |
| BBB14 | 13 | 60.9 | 7.3E−10 | 1 (1) | 0 | | + | Hypothetical protein |
| BBB16 | 8 | 37.1 | 8.3E−07 | 0 (2) | 0 | 37 | + | Oligopeptide ABC transporter (OppA-4) |
| BBB19-A | 21 | 79.5 | 6.3E−12 | 23 (26) | 10 | | + | OspC type A (strain B31) |
| BBB19-K | 24 | 54.1 | 4.5E−09 | 16 (21) | 7 | | + | OspC type K (strain 297) |
| BBC03 | 5 | 15.1 | 2.6E−03 | 1 (4) | 0 | 49 | − | Hypothetical protein |
| BBC06 | 8 | 28.3 | 1.7E−05 | 1 (2) | 1 | 95 | − | EppA (BapA) |
| BBC10 | 11 | 15.7 | 2.0E−03 | 0 (0) | 6 | 63 | + | RevA |
| BBE09 | 4 | 17 | 1.2E−03 | 1 (2) | 4 | 44 | + | Hypothetical protein |
| BBF03 | 23 | 69.1 | 8.3E−11 | 1 (3) | 0 | 80 | − | BdrS (BdrF1) |
| BBF33 | 3 | 140 | 0 | 3 (21) | 9 | | + | VlsE |
| BBG18 | 7 | 28.7 | 1.5E−05 | 1 (2) | 0 | | − | Hypothetical protein |
| BBG33 | 36 | 286.2 | 0 | 11 (16) | 10 | 80 | − | BdrT (BdrF2) |
| BBH06 | 16 | 57.1 | 2.1E−09 | 2 (2) | 0 | | + | Hypothetical protein |
| BBH13 | 30 | 140.7 | 0 | 5 (8) | 4 | 80 | − | BdrU (BdrF3) |

TABLE 1-continued

Immunogenic proteins of *B. burgdorferi* in natural infections of humans and mice

| ORF[a] | Later Lyme disease (n = 39)[b] | F score[c] | P value[d] | Early Lyme disease (n = 44)[e] | Mice (n = 10)[f] | PF | Predicted to be lipoprotein[g] | Deduced gene product[h] |
|---|---|---|---|---|---|---|---|---|
| BBI42 | 16 | 61.5 | 6.4E−10 | 1 (1) | 0 | 52 | + | Hypothetical protein |
| BBJ24 | 6 | 45.5 | 6.0E−08 | 0 (1) | 0 | 106 | − | Hypothetical protein |
| BBK07 | 13 | 40 | 3.3E−07 | 11 (21) | 10 | 59 | + | Hypothetical protein |
| BBK12 | 18 | 41.8 | 1.8E−07 | 12 (22) | 9 | 59 | + | Hypothetical protein |
| BBK13 | 8 | 25.5 | 4.7E−05 | 0 (3) | 2 | 40 | − | Hypothetical protein (COG2859) |
| BBK19 | 12 | 67.8 | 1.2E−10 | 4 (6) | 8 |  | + | Hypothetical protein |
| BBK23 | 4 | 19.5 | 4.6E−04 | 2 (4) | 1 | 62 | − | Hypothetical protein |
| BBK32 | 22 | 122.3 | 0 | 13 (17) | 9 |  | + | Fibronectin-binding protein |
| BBK52 | 3 | 25.4 | 4.9E−05 | 1 (3) | 4 | 44 | + | "P23" |
| BBK53 | 10 | 31.5 | 5.5E−06 | 0 (3) | 3 | 52 | + | Hypothetical protein |
| BBL03 | 9 | 23.7 | 9.0E−05 | 6 (11) | 0 | 148 | − | Hypothetical protein |
| BBL27 | 33 | 229.6 | 0 | 6 (11) | 4 | 80 | − | BdrO (BdrE1) |
| BBL39 | 5 | 23.8 | 8.9E−05 | 0 (3) | 4 | 162 | + | ErpN (CRASP-5) |
| BBL40 | 22 | 51.5 | 9.4E−09 | 6 (7) | 10 | 163 | + | ErpO |
| BBM27 | 18 | 51.6 | 9.3E−09 | 2 (5) | 6 | 63 | + | RevA |
| BBM34 | 27 | 153.1 | 0 | 3 (7) | 6 | 80 | − | BdrK (BdrD2) |
| BBM36 | 3 | 21.5 | 2.1E−04 | 0 (2) | 0 | 144 | − | Hypothetical protein |
| BBN11 | 23 | 84.9 | 1.8E−12 | 2 (3) | 0 | 152 | − | Hypothetical protein |
| BBN27 | 27 | 143.9 | 0 | 3 (6) | 5 | 80 | − | BdrR (BdrE2) |
| BBN28 | 6 | 21 | 2.5E−04 | 0 (2) | 0 | 113 | + | MlpI |
| BBN34 | 31 | 192.1 | 0 | 8 (13) | 4 | 80 | − | BdrQ (BdrD10) |
| BBN38 | 20 | 56.2 | 2.6E−09 | 7 (9) | 2 | 162 | + | ErpP (CRASP-3) |
| BBN39 | 23 | 42.2 | 1.6E−07 | 5 (9) | 9 | 163 | + | ErpQ |
| BBO34 | 27 | 122.7 | 0 | 4 (6) | 3 | 80 | − | BdrM (BdrD3) |
| BBO39 | 23 | 71.1 | 5.0E−11 | 2 (6) | 8 | 164 | + | ErpL |
| BBO40 | 6 | 23.4 | 1.0E−04 | 0 (2) | 6 | 164 | + | ErpM |
| BBP34 | 31 | 190.9 | 0 | 6 (11) | 3 | 80 | − | BdrA (BdrD4) |
| BBP39 | 12 | 25.6 | 4.6E−05 | 4 (9) | 9 | 163 | + | ErpB |
| BBQ03 | 27 | 101.9 | 3.4E−14 | 1 (2) | 5 | 52 | + | Hypothetical protein |
| BBQ04 | 6 | 23.3 | 1.1E−04 | 1 (3) | 4 | 44 | + | Hypothetical protein |
| BBQ13 | 1 | 15.7 | 2.0E−03 | 1 (1) | 2 | 149 | − | Hypothetical protein |
| BBQ19 | 6 | 16.4 | 1.5E−03 | 3 (5) | 2 | 153 | − | Hypothetical protein |
| BBQ34 | 30 | 170.4 | 0 | 3 (7) | 7 | 80 | − | BdrW (BdrE6) |
| BBQ35 | 3 | 15.7 | 2.0E−03 | 1 (3) | 3 | 113 | + | MlpJ |
| BBQ40 | 6 | 11.7 | 9.8E−03 | 3 (5) | 0 | 32 | − | Partition protein |
| BBQ42 | 30 | 179.6 | 0 | 6 (9) | 1 | 80 | − | BdrV (BdrD5) |
| BBR12 | 6 | 13.3 | 5.3E−03 | 0 (2) | 1 | 153 | − | Hypothetical protein |
| BBR35 | 8 | 30.1 | 9.2E−06 | 1 (3) | 0 | 80 | − | BdrG |
| BBR42 | 14 | 47.3 | 3.4E−08 | 1 (1) | 5 | 164 | + | ErpY |
| BBS30 | 0 | 20.5 | 3.0E−04 | 0 (4) | 4 | 113 | + | MlpC |
| BBS41 | 18 | 29.8 | 1.0E−05 | 1 (3) | 7 | 164 | + | ErpG |

[a]Bold type indicates an ORF that had a P value of <0.005 but whose frequency for later Lyme disease sera was <6.
[b]The numbers are the numbers of serum samples whose values were ≧3 SDs above the mean of the controls for the panel. n is the number of individuals in the group for combined panel 1 and 2 sera.
[c]The F score is the Bayes-regularized variance (see the text)
[d]The P value is the corrected P value (0, P < 1.0E−14).
[e]The numbers are the numbers of LB patient serum samples whose values were ≧3 SDs or ≧2 SDs above mean of the controls for panels 1 and 2. n is the number of individuals in the group for combined panel 1 and 2 sera.
[f]The numbers are the numbers of *P. leucopus* sera (out of 10) whose values are ≧3 SDs above the mean for four control *P. leucopus* mice.
[g]+, protein predicted to be a lipoprotein; −, protein not predicted to be a lipoprotein.
[h]Alternative protein designations are given in parentheses.

Several proteins that were known antigens and valuable for serodiagnosis were on the list. These proteins included FlaB (BB0147) (9, 45), the P66 outer membrane protein (BB0603) (5, 16), OspA and OspB (BBA15 and BBA16) (48), decorin-binding protein B (BBA25) (37, 46), OspC (BBB 19) (68, 96), fibronectin-binding protein (BBK32) (71), and VlsE (BBF33) (54, 56). The other reactive Orfs that were previously reported to elicit antibodies during infections of humans or experimental animals were as follows: LA7 (BB0365) (53, 94), the chaperonins DnaK (BB0518) and GroEL (BB0649) (58), FlgE (BB0283) (51), some Erp proteins (59, 85), oligopeptide ABC transporters (OppA; BB0328, BB0329, BBA34, and BBB16) (25, 28, 65), "S2 antigen" (BBA04) (36), the paralogous BBA64 and BBA66 proteins (65), RevA proteins (BBC10 and BBM27) (41, 65), EppA/BapA (BBC06) (63), Mlp proteins (BBN28, BBQ35, and BBS30) (70), and some Bdr proteins (99).

There were several Orfs that previously either were not recognized as immunogens during infection or had received little attention. Notable among this group were the following: (i) the paralogous BBK07 and BBK12 lipoproteins; (ii) BBK19 and BBK53, two other lipoproteins encoded by plasmid 1p36; (iii) several more flagellar apparatus proteins, including FliL (BB0279), FlaA (BB0668), and FlgG (BB0774); (iv) additional paralogous family (PF) 44 proteins (BBE09, BBK53, and BBQ04); (v) BB0260, BB0323, BB0543, and BB0751, hypothetical proteins encoded on the chromosome; (vi) BBA03, BBA07, BBA36, and BBA57, hypothetical proteins or lipoproteins uniquely encoded by 1p54; and (vii) BBG18 and BBH06, unique hypothetical proteins encoded by other plasmids. On the list of new immunogens there were only a few chromosome-encoded Orfs that were homologous to proteins having established functions in other bacteria, such as the phosphate ABC transporter PstS (BB0215), pyruvate kinase (BB0348), a carboxy-terminal protease (BB0359, and a methyl-accepting chemotaxis protein (BB0681).

Whereas plasmid-encoded Orfs accounted for 536 (41%) of the 1,292 B31 Orfs on the array, 70 (69%) of the 102 immunogenic Orfs of strain B31 are plasmid encoded (OR, 3.1 (95% confidence interval, 2.0 to 4.9); exact $P<10^{-6}$). Fifty-nine (58%) Orfs, all but two of which were plasmid encoded, belonged to 1 of 26 PFs. Of a possible 174 Orfs that belong to 1 of these 26 PFs, 114 (66%) were included as amplicons on the array. The greatest representation was that of PF 80, which comprises the Bdr proteins; 12 (92%) of a possible 13 Orfs were on the list of 83 Orfs. These Orfs included high-ranking BBG33 and BBL27 proteins. Other PFs with three or more representatives on the list were the PFs containing the Erp proteins (PFs 162 to 164), oligopeptide ABC transporters (PF 37), Mlp proteins (PF 113), the "S2 antigen" and related proteins (PF 44), and a set of hypothetical proteins with unknown functions (PF 52).

For tabulation of the plasmid locations of the ORFs shown in Table 1, pseudogenes and ORFs were excluded that were less than 300 nucleotides long (21). The sizes of linear plasmids 1p38 (38,829 nucleotides) and 1p36 (36,849 nucleotides) are similar. Only 1 of 1p38's 17 ORFs, BBJ24, was among the ORFs encoding high-ranking antigens, but 8 of the 19 1p36 ORFs were (OR, 11.6 (95% confidence interval, 1.2 to 548); P=0.03). The presence of plasmid 1p36 has been associated in one study with infectivity or virulence in a mammalian host (49), as has been the presence of 1p25 in another study (72), but only BBE09 of the 10 ORFs of 1p25 were among the ORFs encoding immunogens.

Forty-eight (48%) of the 102 immunogens of strain B31 are lipoproteins as determined by prediction or empirical documentation. Of the 756 chromosome-encoded Orfs included in the array, only 32 (4%) are lipoproteins, but, as shown in Table 1, 7 (21%) of the 33 chromosome-encoded Orfs among the immunogens are lipoproteins (OR, 6.1 (95% confidence interval, 2.1 to 15.8); P=0.001). Whereas 85 (16%) of the 536 plasmid-encoded Orfs on the array are predicted lipoproteins, 41 (59%) of the 70 plasmid-encoded proteins of strain B31 on the antigen list are predicted lipoproteins (OR, 7.6 (95% confidence interval, 4.3 to 13.4); $P<10^{-12}$). In addition to five documented outer membrane proteins (OspA, OspB, OspC, VlsE, and P66), the following three hypothetical proteins among the immunogens were predicted to localize to the outer membrane by the PSORT algorithm for double-membrane bacteria (40): BB0260, BB0751, and BB0811.

Stage of infection. In general, sera from early in infection reacted with fewer antigens per serum sample and antigens from a narrower list of antigens. For 20 (83%) of the 24 panel 1 early LB cases there was at least one Orf in Table 1 whose value exceeded the 3-SD cutoff. Of the four cases for which there was not at least one Orf whose value exceeded the 3-SD cutoff, three (75%) were seronegative as determined by ELISA and IgG and IgM Western blotting. Of the 20 cases of early infection for serum panel 2, 17 (85%) had at least one Orf whose value was >3 SDs. For the 37 samples with one or more reactive Orfs, the number of Orfs whose values were above the threshold ranged from 1 to 37, and the median number was five Orfs per sample. For the 84 antigens identified by the first analysis, the values for 69 (82%) were above the threshold for at least one of the early-infection sera (Table 1). In most cases, the following 15 Orfs whose values fell below the cutoff with all early sera were also among the least prevalent Orfs for sera obtained later in disease: BB0408, BB0476, BB0751, BB0805, BB0844, BBA04, BBB09, BBB16, BBC10, BBJ24, BBK13, BBK53, BBN28, BBO40, and BBR12. The Orfs whose values exceeded the cutoff in at least 10 of the 37 samples were, in descending order, BBA25 (DbpB), BBB19 (OspC type A), BBB19 (OspC type K), BBK32 (fibronectin-binding protein), BBK12, BBG33 (BdrT), BBK07, and BB0279 (FliL).

Sera of the 10 patients with refractory Lyme arthritis were compared with sera of the 10 patients with arthritis that responded to antibiotic therapy. As determined by a t test and nonparametric rank test of log-transformed values, there was not a significant difference (P>0.05) between the two groups for any of the 1,293 Orfs, including both OspC proteins.

White-footed mouse antibodies. Using the same batch of genome-wide arrays, the reactions of sera from 10 *P. leucopus* mice were examined that were captured in an area in which the level of *B. burgdorferi* infection of mice approached 100% by the end of the transmission season (18). All 10 mice were seropositive as determined by the whole-cell assay and Western blot analysis (18). These sera were compared with sera from four laboratory-reared *P. leucopus* mice. As described above, the number of SDs above or below the mean of the controls was calculated for each Orf and each mouse serum. Of the 103 Orfs shown in Table 1, only 30 (29%) were not represented at least once among the Orfs with values of $\geq 3$ SDs with *P. leucopus* sera. The highest frequencies ($\geq 7$ of 10 sera) were those of the following Orfs, in alphabetical order: BB0279, BB0286, BB0844, BBA25, BBA36, BBA57, BBA64, BBB19 (OspC types A and K), BBF33, BBG33, BBK07, BBK12, BBK19, BBK32, BBL40, BBN39, BBO39, BBP39, BBQ34, and BBS41. Thirteen Orfs had frequencies of $\geq 5$ among the 10 *P. leucopus* sera but were not among the high-ranking Orfs with human sera (Table 1). These Orfs included two hypothetical proteins (BB0039 and BB0428), two members of PF 143 (BBP26 and BBS26), and the BBK50 protein, another 1p36-encoded protein. But also represented among the high-ranking Orfs with *P. leucopus* sera were members of PFs, at least one of which was frequently recognized by human antibodies, including two additional PF 113 proteins, MlpH (BBL28) and MlpA (BBP28); another PF 164 protein, ErpK (BBM38); and an additional PF 54 protein, BBA73. Overall, there was considerable overlap in the sets of immunogens for humans and *P. leucopus* infected with *B. burgdorferi*.

Figure 2:
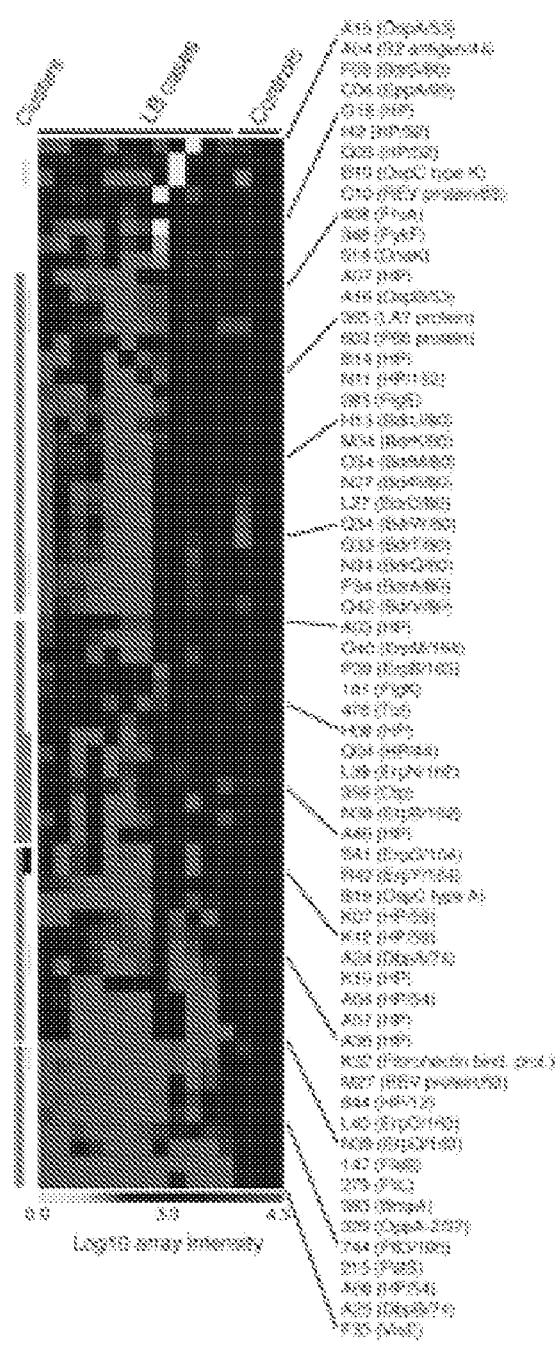
FIG. 2 shows a two-color display of a Euclidian distance cluster analysis of a small array with immunogenic Orfs of *B. burgdorferi* as described in Example 1. The array was incubated with 12 sera from individuals with later LB (panel 1) or three control sera. In addition to selected Orfs from Table 1, the following three proteins were used: BB0383 (BmpA), BB0744 (P83/100), and BBA24 (DbpA). The Orf designations do not include "BB." Protein names and hypothetical proteins (HP), as well as the PFs, are indicated on the right. Clusters are indicated on the left. The levels of bootstrap support (1,000 iterations) are as follows: orange (dark gray), >50%; yellow (light gray), >60%; and black, 100%. A scale for $\log_{10}$ intensity values is at the bottom.

Second array. To confirm the results described above, we produced a second array with 66 recombinant proteins selected from the 103 Orfs shown in Table 1. The second array contained three additional proteins that were not cloned for the first array. Two of these, BB0383 (BmpA or P39 protein) and BB0744 (P83/100 protein), are among the 10 signal antigens for a commonly used criterion for Western blot interpretation (33). The third additional ORF was BBA24 or decorin-binding protein A (DbpA). The smaller arrays were incubated with 12 later LB sera and three control sera from panel 1. FIG. 2 shows the results in a two-color gradient format with an accompanying cluster analysis. BB0383 and BB0744 clustered with several other proteins that were frequently bound by antibodies of LB sera, including FlaB (BB0147), BB0279 (FliL), VlsE, and DbpB (BBA25). The patterns of reactivity with different patient and control sera were essentially the same for these antigens. This was demonstrated by correlations between the Orfs; for BB0383, the $R^2$ values for BB0279, BB0147, VlsE, and BBA25 were 0.90, 0.86, 0.70, and 0.58, respectively, and for BB0744, the corresponding $R^2$ values were 0.91, 0.81, 0.71, and 0.74, respectively. DbpA (BBA24), whose sequence is genetically more diverse than that of DbpB across strains (76), was less frequently reactive with the collection of patient sera than DbpB. Thus, addition of the P83/100, BmpA, or DbpA protein to the array provided little or no additional discriminatory power.

Figure 3:
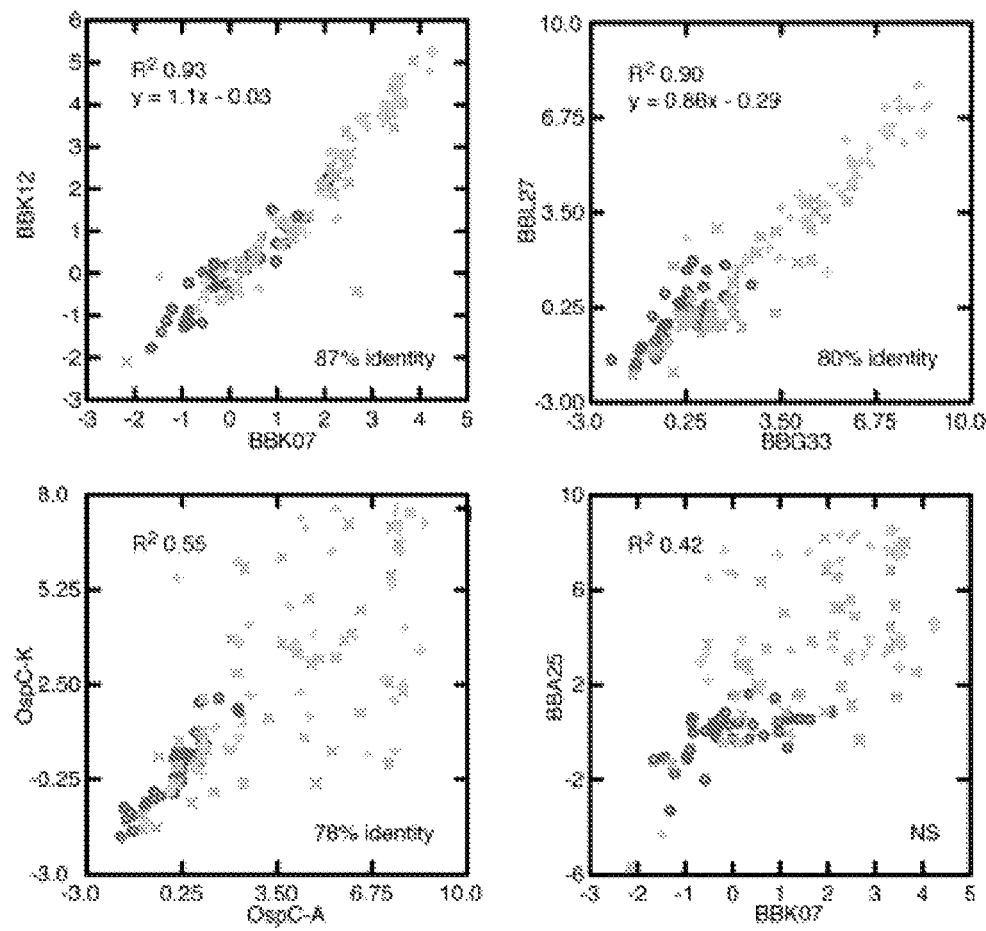

FIG. 2 also shows clustering of the Bdr proteins and the BBK07/BBK12 proteins but not of the two OspC proteins in terms of their patterns and intensities of reactivities with this set of sera. The relationship between clustering of Orfs and amino acid sequence identity was examined by plotting normalized values for individual panel 1 control, early LB, and later LB sera and for selected pairs of Orfs (FIG. 3). There was high correlation between the paralogous proteins BBK07 and BBK12 and between two Bdr proteins, BBG33 and BBL27, in the serum antibody reactions. The data corresponded to amino acid sequence identities of 87 and 80%, respectively. In contrast, there were greater differences in the reactivities of sera with the two OspC proteins, even though the overall level of identity between them was close to that of the two Bdr proteins. Lower still was the correlation between two high-ranking proteins which are similar sizes but are not homologous, BBK07 and BBA25.

Figure 4:
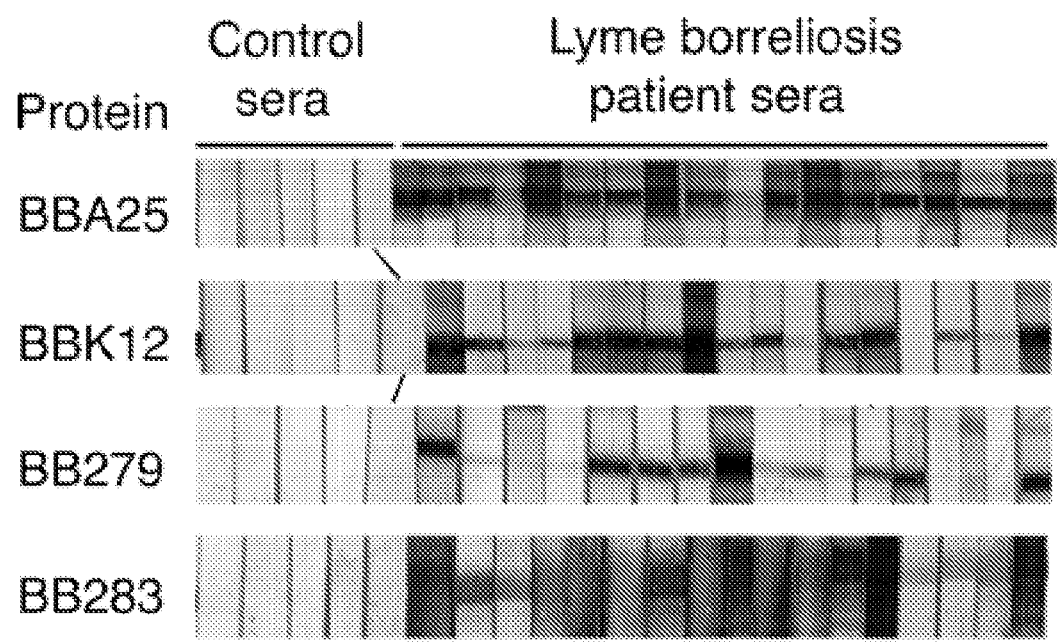
FIG. 4 shows a Western blot analysis of purified recombinant proteins encoded by ORFs BBA25 (DbpB), BBK12, BB279 (FliL), and BB283 (FlgE) incubated with sera of 17 patients with later LB or five panel controls as described in Example 1. Binding of antibody was detected with alkaline phosphatase-labeled secondary antibody to human IgG as described in the text.
Figure 5:
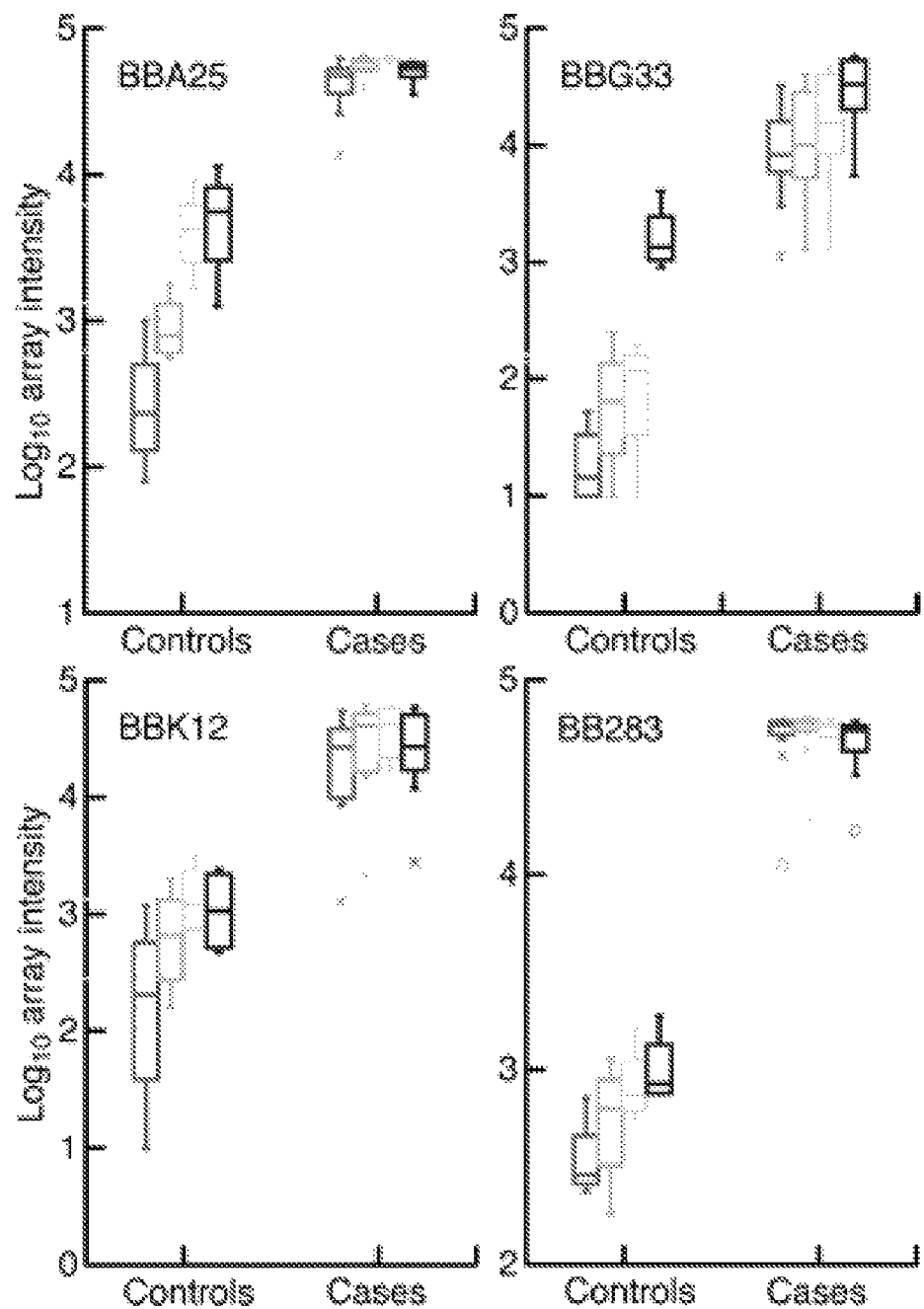
FIG. 5 shows binding of antibodies in human LB sera to purified proteins on arrays as described in Example 1. The plots are box-whisker plots of log-transformed intensity values for the binding of panel 1 sera from patients with later LB (n=17) or controls (n=5) with purified recombinant proteins encoded by ORFs BBA25, BBG33, BBK12, and BB283 at concentrations of 0.03 mg/ml (dark gray), 0.1 mg/ml (medium gray), 0.3 (light gray), and 0.9 mg/ml (black). Each box indicates the first and third quartiles, and the line inside the box is the median. The 1.5× interquartile range is indicated by the vertical line bisecting the box, and values outside this range are indicated by asterisks and by circles.

Purified proteins. Five Orfs were selected for further investigation as purified recombinant proteins: BB0279 (FliL), (FlgE), BBA25 (DbpB), BBG33 (BdrT), and BBK12. Western blot analyses were carried out with sera from 17 patients with later LB and five panel 1 controls (FIG. 4). Binding that was noted in the array was confirmed by Western blotting; no bands were observed with the control sera. Different amounts of proteins BBA25, BBG33, BBK12, and BB283 were then used over a 30-fold range in an array format and incubated the chips with the same patient and control sera (FIG. 5). While for some proteins the binding by control sera increased with higher protein concentrations, the log-transformed raw values for patient sera changed little over the concentration range used, an indication that the absolute amount of protein in the spots of the high-throughput array over this range was not a major determinant of the amount of antibody binding as estimated by digitization of the signals for this study. When binding to in vitro-produced proteins on the array was compared to binding to different amounts of a purified protein for a given Orf for a standard curve, we estimated that the amounts of Orfs in the genome-wide array were 50 to 400 pg protein per spot.

Figure 6:
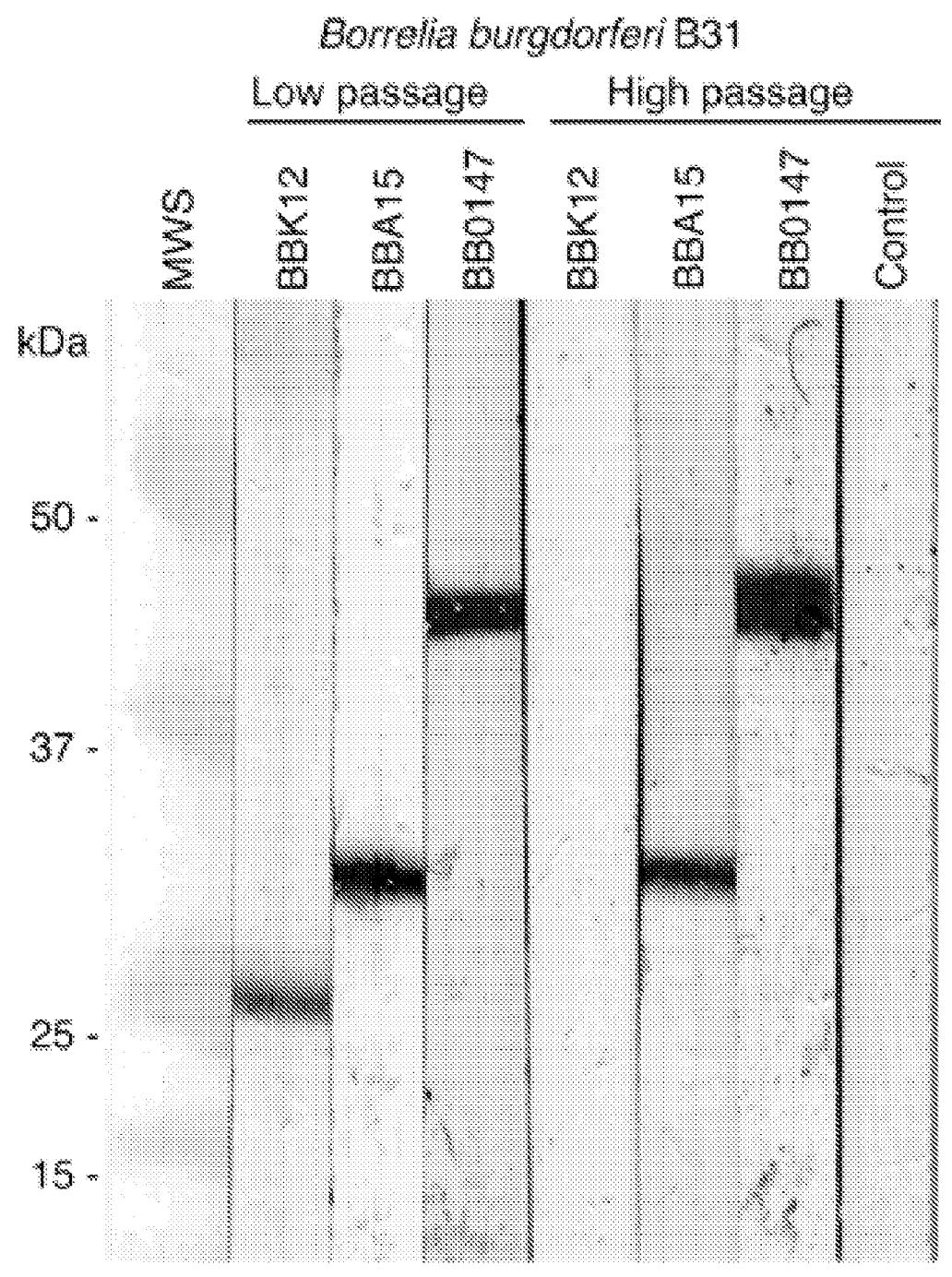

While detection of antibody to an Orf was evidence of expression of the predicted polypeptide, this evidence was indirect. One of the purified proteins, BBK12, was used to immunize mice and thereby provide a reagent for more direct documentation of expression. It is noted that such immunization could be performed with any of the proteins found to be immunogenic (e.g., in Table 1 or Table 3) in order to generated an antibody reagent for diagnostic or other applications. This Orf was chosen because it and the product of a paralogous gene, BBK07, had not been previously reported to be immunogenic. In fact, there was little previous comment on either of these proteins beyond their annotation as hypothetical lipoproteins with unknown functions. FIG. 6 shows a Western blot in which lysates of low-passage or high-passage strain B31 were incubated with the anti-BBK12 antiserum or monoclonal antibodies to OspA (BBA15) or FlaB (BB0147). Because of the probable antigenic cross-reactivity between BBK07 and BBK12, as the analysis shown in FIG. 3 suggests, it could not be assumed that the antiserum could easily distinguish between the two Orfs. As expected, FlaB and OspA were expressed by both low- and high-passage isolates of strain B31. In contrast, the BBK12 and/or BBK07 protein was detected in low-passage cells but not in high-passage cells. This experiment not only confirmed that there was expression of either BBK12 or BBK07 or both but also showed that loss of expression of these proteins was associated with high passage. Thus, one explanation for the previous lack of recognition of informative antigens, such as BBK07 and BBK12, was that higher-passage cell populations, which were often used as the basis of diagnostic assays, did not express the proteins, either because of plasmid loss or because of transcriptional or translational failure.

How many antigens are sufficient? This Example permitted study an estimation of the minimum number of antigens that would be needed to achieve a highly specific *B. burgdorferi* diagnostic assay. For this, the discriminatory power of different sets of ORFs was studied using receiver operating characteristic (ROC) curves, where the false-positive rate (1—specificity) is the x axis and the true positive rate (sensitivity) is the y axis for different thresholds of the underlying classifier. The area under the curve (AUC) summarizes the results. An AUC of 1.0 indicates a perfect classifier, while an AUC of 0.51 (95% confidence interval, 0.38 to 0.64) is the expected value for a classifier that works by chance for the data set, as inferred by the method of Truchon and Bayly (89). The log-transformed data for controls and later LB sera from both panels were used for this analysis. First, ROC curves were generated for single antigens to assess the ability to separate the control and disease. The Orf number is the rank based on the Bayes-regularized ANOVA F score (see Table 5).

TABLE 5

| Rank | Open reading frame | Controls mean | Mean area under curve | Lower 95% CI | Upper 95% CI |
|---|---|---|---|---|---|
| 1 | BBG33 | 0.021 | 0.988 | 0.985 | 0.991 |
| 2 | BB0279 | 0.030 | 0.978 | 0.973 | 0.983 |
| 3 | BBL27 | -0.034 | 0.997 | 0.997 | 0.998 |
| 4 | BB0329 | 0.026 | 0.981 | 0.976 | 0.986 |
| 5 | BBN34 | 0.020 | 0.984 | 0.981 | 0.988 |
| 6 | BBP34 | 0.067 | 0.987 | 0.985 | 0.990 |
| 7 | BBQ42 | 0.000 | 0.984 | 0.981 | 0.988 |
| 8 | BBQ34 | -0.022 | 0.980 | 0.976 | 0.985 |
| 9 | BBM34 | 0.023 | 0.977 | 0.973 | 0.980 |
| 10 | BB0283 | -0.035 | 0.949 | 0.944 | 0.953 |
| 11 | BBN27 | -0.016 | 0.981 | 0.977 | 0.985 |
| 12 | BBH13 | 0.019 | 0.958 | 0.953 | 0.963 |
| 13 | VlsE | -0.012 | 0.968 | 0.963 | 0.972 |
| 14 | BBA25 | 0.008 | 0.974 | 0.968 | 0.981 |
| 15 | BBO34 | 0.039 | 0.965 | 0.961 | 0.969 |
| 16 | BBK32 | -0.022 | 0.974 | 0.970 | 0.979 |
| 17 | BBQ03 | 0.003 | 0.926 | 0.917 | 0.934 |
| 18 | BBN11 | 0.018 | 0.951 | 0.947 | 0.955 |
| 19 | BB0147 | 0.022 | 0.967 | 0.961 | 0.973 |
| 20 | OspC_A | 0.019 | 0.911 | 0.904 | 0.919 |
| 21 | BBA34 | 0.025 | 0.967 | 0.963 | 0.971 |
| 22 | BBA64 | 0.024 | 0.927 | 0.917 | 0.937 |
| 23 | BBO39 | 0.000 | 0.905 | 0.897 | 0.913 |
| 24 | BBF03 | 0.028 | 0.903 | 0.897 | 0.909 |
| 25 | BBK19 | 0.016 | 0.897 | 0.885 | 0.909 |
| 26 | BB0518 | -0.014 | 0.933 | 0.928 | 0.938 |
| 27 | BBI42 | 0.016 | 0.928 | 0.921 | 0.935 |
| 28 | BBB14 | 0.030 | 0.917 | 0.911 | 0.924 |
| 29 | BB0348 | -0.003 | 0.896 | 0.887 | 0.905 |
| 30 | BBA16 | 0.016 | 0.910 | 0.905 | 0.915 |
| 31 | BBH06 | -0.001 | 0.898 | 0.889 | 0.907 |
| 32 | BBN38 | 0.007 | 0.881 | 0.869 | 0.892 |
| 33 | BB0215 | 0.021 | 0.885 | 0.877 | 0.894 |
| 34 | BB0603 | 0.017 | 0.964 | 0.956 | 0.971 |
| 35 | OspC_K | 0.012 | 0.877 | 0.869 | 0.885 |
| 36 | BBA36 | 0.053 | 0.878 | 0.869 | 0.888 |
| 37 | BBM27 | 0.016 | 0.874 | 0.866 | 0.882 |
| 38 | BBL40 | 0.024 | 0.834 | 0.821 | 0.847 |
| 39 | BB0359 | 0.036 | 0.872 | 0.863 | 0.882 |
| 40 | BBR42 | 0.015 | 0.912 | 0.904 | 0.921 |
| 41 | BBJ24 | 0.012 | 0.911 | 0.904 | 0.919 |
| 42 | BB0543 | 0.009 | 0.883 | 0.877 | 0.889 |
| 43 | BB0774 | 0.011 | 0.882 | 0.877 | 0.888 |
| 44 | BB0365 | 0.014 | 0.935 | 0.927 | 0.943 |

TABLE 5-continued

| Rank | Open reading frame | Controls mean | Mean area under curve | Lower 95% CI | Upper 95% CI |
|---|---|---|---|---|---|
| 45 | BB0844 | 0.061 | 0.846 | 0.834 | 0.859 |
| 46 | BBN39 | −0.010 | 0.790 | 0.777 | 0.804 |
| 47 | BBK12 | 0.019 | 0.804 | 0.788 | 0.820 |
| 48 | BBA07 | 0.047 | 0.837 | 0.827 | 0.847 |
| 49 | BBK07 | 0.018 | 0.830 | 0.818 | 0.842 |
| 50 | BBA57 | 0.053 | 0.851 | 0.841 | 0.862 |
| 51 | BB0323 | 0.022 | 0.867 | 0.860 | 0.875 |
| 52 | BBB16 | 0.016 | 0.861 | 0.852 | 0.871 |
| 53 | BB0681 | 0.014 | 0.830 | 0.823 | 0.836 |
| 54 | BBA03 | 0.016 | 0.849 | 0.839 | 0.859 |
| 55 | BBB09 | 0.005 | 0.823 | 0.812 | 0.835 |
| 56 | BBA66 | 0.002 | 0.881 | 0.872 | 0.890 |
| 57 | BB0238 | 0.020 | 0.848 | 0.844 | 0.853 |
| 58 | BBA48 | 0.025 | 0.825 | 0.817 | 0.833 |
| 59 | BB0408 | 0.032 | 0.805 | 0.798 | 0.812 |
| 60 | BBK53 | 0.013 | 0.827 | 0.816 | 0.837 |
| 61 | BBR35 | 0.034 | 0.828 | 0.815 | 0.840 |
| 62 | BBS41 | 0.021 | 0.829 | 0.818 | 0.839 |
| 63 | BB0286 | −0.044 | 0.825 | 0.815 | 0.835 |
| 64 | BB0385 | 0.015 | 0.885 | 0.876 | 0.893 |
| 65 | BBG18 | 0.022 | 0.819 | 0.809 | 0.828 |
| 66 | BBA15 | 0.010 | 0.765 | 0.756 | 0.774 |
| 67 | BBC06 | 0.021 | 0.840 | 0.832 | 0.848 |
| 68 | BB0181 | 0.004 | 0.800 | 0.791 | 0.808 |
| 69 | BB0328 | 0.034 | 0.820 | 0.809 | 0.832 |
| 70 | BBP39 | 0.017 | 0.797 | 0.789 | 0.806 |
| 71 | BBK13 | 0.018 | 0.806 | 0.791 | 0.821 |
| 72 | BBK52 | 0.002 | 0.802 | 0.788 | 0.816 |
| 73 | BB0751 | 0.018 | 0.779 | 0.771 | 0.787 |
| 74 | BBA63 | 0.022 | 0.779 | 0.765 | 0.793 |
| 75 | BBL39 | −0.006 | 0.833 | 0.825 | 0.842 |
| 76 | BBL03 | −0.007 | 0.775 | 0.765 | 0.785 |
| 77 | BBO40 | −0.002 | 0.799 | 0.790 | 0.807 |
| 78 | BBQ04 | −0.002 | 0.791 | 0.774 | 0.807 |
| 79 | BBA19 | 0.002 | 0.751 | 0.742 | 0.760 |
| 80 | BB0668 | 0.051 | 0.795 | 0.785 | 0.804 |
| 81 | BBM36 | 0.007 | 0.785 | 0.774 | 0.796 |
| 82 | BBN28 | 0.050 | 0.764 | 0.750 | 0.778 |
| 83 | BB0649 | 0.019 | 0.816 | 0.810 | 0.823 |
| 84 | BBS30 | 0.004 | 0.827 | 0.818 | 0.835 |
| 85 | BB0811 | 0.029 | 0.754 | 0.738 | 0.770 |
| 86 | BB0476 | 0.031 | 0.768 | 0.755 | 0.780 |
| 87 | BBK23 | 0.030 | 0.764 | 0.750 | 0.778 |
| 88 | BB0260 | −0.077 | 0.767 | 0.756 | 0.778 |
| 89 | BB0056 | 0.022 | 0.737 | 0.723 | 0.751 |
| 90 | BB0048 | 0.032 | 0.746 | 0.735 | 0.757 |
| 91 | BB0108 | 0.014 | 0.804 | 0.792 | 0.817 |
| 92 | BBA40 | 0.016 | 0.746 | 0.738 | 0.755 |
| 93 | BB0337 | 0.029 | 0.777 | 0.769 | 0.785 |
| 94 | BBE09 | 0.007 | 0.756 | 0.741 | 0.770 |
| 95 | BB0652 | 0.013 | 0.739 | 0.723 | 0.756 |
| 96 | BBQ19 | 0.016 | 0.717 | 0.703 | 0.730 |
| 97 | BBQ35 | 0.009 | 0.797 | 0.786 | 0.808 |
| 98 | BBQ13 | 0.026 | 0.746 | 0.734 | 0.758 |
| 99 | BBC10 | 0.017 | 0.699 | 0.690 | 0.708 |
| 100 | BBC03 | 0.017 | 0.737 | 0.726 | 0.748 |
| 101 | BBR28 | 0.017 | 0.756 | 0.748 | 0.764 |
| 102 | BB0357 | 0.013 | 0.766 | 0.752 | 0.780 |
| 103 | BBO20 | 0.027 | 0.736 | 0.727 | 0.745 |
| 104 | BBK40 | 0.019 | 0.733 | 0.721 | 0.745 |
| 105 | BB0772 | 0.019 | 0.697 | 0.683 | 0.710 |
| 106 | BB0628 | −0.003 | 0.710 | 0.700 | 0.720 |
| 107 | BBM38 | −0.031 | 0.788 | 0.775 | 0.802 |
| 108 | BBG25 | 0.028 | 0.724 | 0.714 | 0.734 |
| 109 | BBE10 | 0.022 | 0.727 | 0.715 | 0.739 |
| 110 | BBJ34 | 0.019 | 0.752 | 0.742 | 0.762 |
| 111 | BBM28 | 0.001 | 0.733 | 0.719 | 0.747 |
| 112 | BBA61 | 0.016 | 0.720 | 0.706 | 0.733 |
| 113 | BBA70 | 0.014 | 0.729 | 0.713 | 0.746 |
| 114 | BBR12 | 0.033 | 0.704 | 0.691 | 0.718 |
| 115 | BB0384 | 0.011 | 0.733 | 0.719 | 0.747 |
| 116 | BB0805 | 0.029 | 0.709 | 0.694 | 0.725 |
| 117 | BBA10 | 0.010 | 0.729 | 0.715 | 0.744 |
| 118 | BB0502 | 0.026 | 0.691 | 0.674 | 0.708 |
| 119 | BBK50 | 0.016 | 0.727 | 0.715 | 0.739 |
| 120 | BBB12 | 0.021 | 0.714 | 0.699 | 0.730 |
| 121 | BBA04 | 0.002 | 0.688 | 0.675 | 0.700 |
| 122 | BB0144 | 0.028 | 0.714 | 0.700 | 0.729 |
| 123 | BBN33 | 0.024 | 0.732 | 0.721 | 0.744 |
| 124 | BBA58 | 0.032 | 0.687 | 0.676 | 0.698 |
| 125 | BBO16 | 0.031 | 0.690 | 0.682 | 0.698 |
| 126 | BB0159 | 0.017 | 0.743 | 0.734 | 0.752 |
| 127 | BBP26 | 0.020 | 0.692 | 0.681 | 0.703 |
| 128 | BBQ40 | 0.032 | 0.690 | 0.674 | 0.705 |
| 129 | BBK46 | 0.007 | 0.723 | 0.710 | 0.736 |
| 130 | BBE02 | 0.036 | 0.746 | 0.732 | 0.759 |
| 131 | BBA20 | 0.002 | 0.687 | 0.678 | 0.695 |
| 132 | BBQ54 | 0.025 | 0.710 | 0.698 | 0.722 |
| 133 | BBH32 | 0.017 | 0.699 | 0.683 | 0.714 |
| 134 | BB0028 | 0.016 | 0.712 | 0.703 | 0.722 |
| 135 | BBG23 | 0.012 | 0.686 | 0.674 | 0.698 |
| 136 | BB0461 | 0.026 | 0.674 | 0.659 | 0.689 |
| 137 | BBA68 | −0.045 | 0.670 | 0.659 | 0.681 |
| 138 | BB0651 | 0.019 | 0.719 | 0.705 | 0.733 |
| 139 | BBD08 | 0.016 | 0.652 | 0.642 | 0.661 |
| 140 | BBJ40 | 0.015 | 0.717 | 0.702 | 0.731 |
| 141 | BBL28 | 0.001 | 0.712 | 0.702 | 0.722 |
| 142 | BB0039 | −0.013 | 0.697 | 0.681 | 0.714 |
| 143 | BBS36 | 0.028 | 0.676 | 0.659 | 0.692 |
| 144 | BBF01 | −0.026 | 0.683 | 0.670 | 0.695 |
| 145 | BB0142 | −0.002 | 0.718 | 0.707 | 0.730 |
| 146 | BBN20 | 0.036 | 0.657 | 0.645 | 0.669 |
| 147 | BB0214 | −0.020 | 0.689 | 0.680 | 0.697 |
| 148 | BBQ76 | 0.017 | 0.688 | 0.672 | 0.704 |
| 149 | BB0739 | 0.019 | 0.671 | 0.662 | 0.680 |
| 150 | BBN12 | 0.024 | 0.657 | 0.647 | 0.668 |
| 151 | BBS26 | −0.001 | 0.673 | 0.665 | 0.681 |
| 152 | BB0517 | 0.005 | 0.656 | 0.646 | 0.666 |
| 153 | BBQ08 | 0.023 | 0.674 | 0.663 | 0.685 |
| 154 | BBN26 | 0.015 | 0.661 | 0.653 | 0.669 |
| 155 | BBG01 | 0.092 | 0.645 | 0.627 | 0.663 |
| 156 | BBM03 | −0.017 | 0.662 | 0.651 | 0.673 |
| 157 | BBF25 | 0.017 | 0.654 | 0.642 | 0.665 |
| 158 | BBJ26 | 0.020 | 0.648 | 0.634 | 0.663 |
| 159 | BBJ25 | 0.017 | 0.647 | 0.640 | 0.654 |
| 160 | BB0424 | 0.018 | 0.673 | 0.658 | 0.688 |
| 161 | BBH29 | 0.023 | 0.639 | 0.628 | 0.650 |
| 162 | BBE19 | 0.016 | 0.664 | 0.652 | 0.675 |
| 163 | BBF13 | 0.012 | 0.657 | 0.644 | 0.669 |
| 164 | BBO02 | 0.002 | 0.645 | 0.631 | 0.659 |
| 165 | BB0150 | 0.001 | 0.649 | 0.637 | 0.662 |

The top Orfs discriminate very well. The first nine Orfs all have an AUC of >0.95, and further down the rank, the ability diminishes. The 25th immunogen has an AUC of 0.90, the 50th immunogen has an AUC of 0.85, the 100th immunogen has an AUC of 0.74, and the 165th Orf has an AUC of 0.65, which still exceeds the upper 95% confidence interval for random expectations for the AUC.

Figure 7:
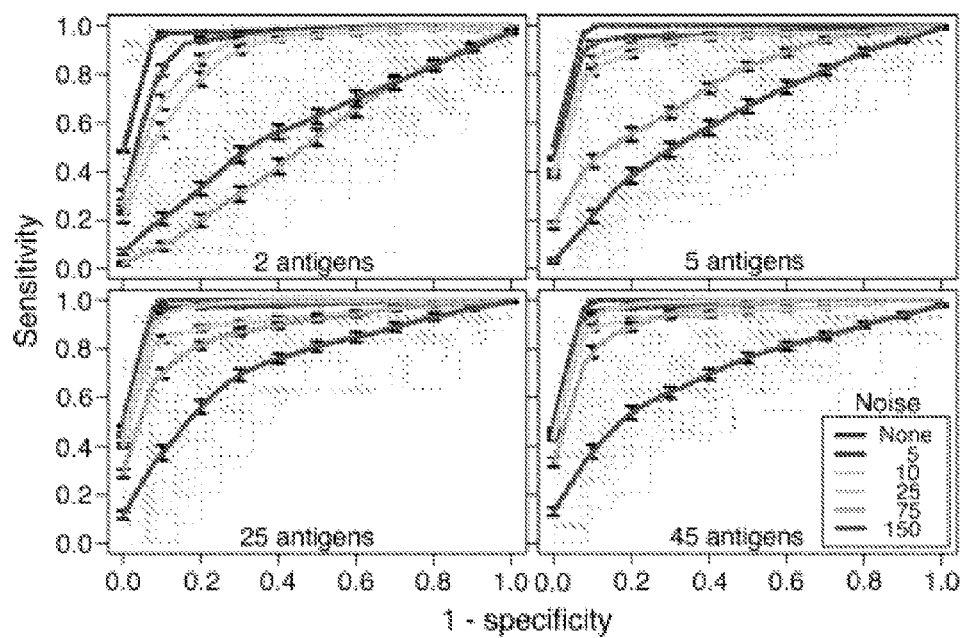
FIG. 7 shows an exemplary estimation of the number of immunogens for assays with a particular level of high sensitivity and specificity. The graphs show four receiver operating characteristic curves for nonlinear classifiers with different sets of Orfs and the effect of increasing the amounts of uniform Gaussian noise with a mean of 0 and an SD of 5, 10, 25, 75, or 150. The antigens in sets containing 2, 5, 25, and 45 antigens were selected in order of their ranking by the Bayes-regularized analysis. The solid lines indicate the average with standard error over cross-validation runs calculated at stepped (1—specificity) points. The error bars indicate 95% confidence intervals. The dotted lines indicate the performance for each of 10 threefold cross-validation iterations.

To extend the analysis to combinations of antigens, kernel methods and support vector machines were used, as described by Vapnik (92), to build linear and nonlinear classifiers. Different kernels, including linear, polynomial, and radial basis function, were evaluated. Only the radial basis function kernel showed an increase in the AUC when noise was added, and accordingly, this kernel was chosen for subsequent simulations in which noise was introduced. For each data set, the support vector machines were tuned using a wide parameter sweep to achieve the best gamma and cost values. Results were validated with 10 runs of threefold cross-validation. As input to the classifier, the highest-ranking 2, 5, 25, and 45 Orfs were used on the basis of either Bayes-regularized ANOVA F scores or frequencies of later LB sera exceeding a 3-SD cutoff. The results of two ranking schemes were similar, and only the frequency ranking results are shown in FIG. 7.

For the present data set, there were negligible differences in the ROC curves obtained using 2, 5, 25, or 45 antigens. The mean AUC values over the 10 validation runs were >0.98 for two antigens and a perfect 1.0 for five or more antigens. The unsurpassable performance in this experiment with relatively few antigens may be attributed to the high discrimination provided by the first several antigens on the list by themselves. In a realistic diagnostic setting with sera coming from various sources and backgrounds and with interoperator variances, one might expect some addition of noise in the data. To further examine how combinations of antigens increase the discriminatory power, two different noise models and their effects on the classifiers were explored. The noise model involves the addition of uniform Gaussian noise. Each point (u) in the data set has some noise added such that $u'=u+N$ ($\mu=0$, $\sigma^2=s$), where s is constant across the whole data set. Noise levels are generated by scaling s. In general, using more antigens in the classifier increases resistance of the simulated assay to noise. All of the classifiers discriminate very well with low noise levels. For the two-antigen classifier, the AUC dropped to the value expected by chance by the time noise was at a scale of 75. The five-antigen classifier value dropped to 0.6 with a noise level of 150. The 25- and 45-antigen classifiers still performed relatively well, with mean AUC values of 0.74 and 0.71, respectively. Hence, based on the criteria of high predictive value and robustness in the face of increasing noise, 25 antigens were as informative as 45 antigens.

Discussion

The genome-wide protein array for *B. burgdorferi* allowed comparison of far more proteins than could be compared previously with one-dimensional Western blots (8, 24, 33). While comparable numbers of proteins for analysis might theoretically be obtained with two-dimensional electrophoresis (66), scarce immunogens in the lysates would be overlooked. Moreover, unless the microbe's cells were taken directly from an infected animal, informative antigens that were expressed only in vivo would be not be included from samples subjected to electrophoresis. This Example of natural infections of humans and white-footed mice with *B. burgdorferi* followed genome-wide array analyses of antibody responses to poxvirus infections in humans immunized with a smallpox vaccine and to *F. tularensis* infections in experimental animals (29, 35, 87) and ELISA format studies of *T. pallidum* ORFs (11, 61). The major emphasis of the previous studies was identification of immunogens after immunization with whole microbes or during infection. That same goal was pursued in this Example in the study of natural infections that occurred in two very different ecological settings: (i) patients with different stages of Lyme disease, including the arthritis in later disease, and (ii) white-footed mice, which are a major reservoir host of *B. burgdorferi* in the United States and in which infection is nearly universal in enzootic areas. As discussed below, the goal of discovery of new antigens was met: many new immunogens were identified among the Orfs of *B. burgdorferi*.

Of equal interest was a second question: how many of the predicted proteins of this pathogen elicit an antibody response during natural infection? For this, the concern was the set of proteins that were not demonstrably immunogenic. Only by including most of a genome's ORFs in the experiment could one address this question, which as a general principle is relevant to many other infectious diseases. Important for hypothesis testing for this second goal was the likelihood of false negatives or type II errors. If minimizing false positives or type I errors (i.e., inaccurately identifying an Orf as an immunogen) was the experimental design challenge for the first goal, then minimizing false negatives (i.e., overlooking Orfs that were truly immunogenic) was the challenge for the second goal. In the present study, type II errors could happen for several reasons.

Indisputably, failure to amplify, clone, and then express a given ORF would lead to a miss of an Orf that was actually immunogenic. Of the ~20% of the Orfs that were absent from the array, undoubtedly some elicit antibody responses during infection. But in many of these cases, the missing Orf was a member of a PF, at least one member of which was represented in the array. Other ORFs were not included because they had characteristics of pseudogenes. Taking these considerations into account, it was estimated that at least 90% of the nonredundant ORFs that were true genes were included in the array analysis. When called for, some missing ORFs were successfully amplified in reattempts using either the original primers or modifications of the primers. In these instances, addition of the antigens missing from first array to a second array did not materially change the results. This suggests that returns diminish as further efforts to fully constitute the array consume greater resources.

Another basis for type II errors would be posttranslational modifications that are important for antibody recognition that occur in *B. burgdorferi* but not in *E. coli*. While one cannot rule out a limitation to the study for this reason, there is no evidence or only scant evidence that glycosylation or a similar posttranslational modification affects antigenicity in *Borrelia* spp. The most prevalent protein modification in *Borrelia* spp. appears to be the addition of a lipid moiety to the N terminus of the processed proteins in a fashion typical of many types of bacteria. While *E. coli* cells are capable of carrying out this lipidation function for recombinant *Borrelia* proteins, this activity did not occur in the acellular transcription-translation reactions used here. This indicates that the significantly greater representation of lipoproteins among immunogens than that expected based on a lipoprotein's size among all Orfs was not attributable to antibodies to the lipid moieties themselves. Instead, the comparatively greater immunogenicity of lipoproteins may be a consequence of the mitogenicity and adjuvant like qualities of bacterial lipopeptides. For the 1,292 B31 ORFs that were successfully amplified, cloned, and expressed, some of the products may have been overlooked as immunogens because their epitopes are conformational and proper folding was not achieved in the in vitro reaction or subsequently when the polypeptide was printed. This possibility cannot be rule out. But the correct calls for the well-established antigens included in the array, such as OspC, FlaB, P66, P83/100, BmpA, fibronectin-binding protein, and VlsE, among others, as "immunogens" indicate that there were few instances of type II errors on the basis of loss of conformational epitopes or some other artifact of the procedures.

Another limitation of the study, at least in the case of the human sera, was the restriction of secondary antibodies to antibodies that were specific for IgG. By failing to account for IgM antibody binding, the total number instances in which the Orfs were recognized by antibodies during early infection may have been under estimated. However, it is not suspected that this effect was great if it occurred at all. There was no instance of an Orf that was recognized by antibodies in sera from early infection and not by antibodies obtained later in the disease. The rationale for limiting antibody detection to IgG was the generally poorer specificity of IgM-based assays for Lyme disease (34, 91). The importance of eventually evaluating antigens for their predictive value with IgM as well as IgG antibodies is recognized, but the focus here was on identification of immunogens with the greatest informative value (that is, with high specificity as well as sensitivity).

Notwithstanding the actual and theoretical limitations of the study, we concluded that the array results were not confined to identification of new immunogens but could also be used to gauge the proportion of proteins that are not immunogens. As far as it is known, this perspective on immune responses during natural infection is unique among studies of proteomes of bacteria, fungi, or parasites. By taking this perspective, it was estimated that the number of Orfs that elicited antibodies in at least some individuals that were infected was about 200, or ~15% of the 1,292 Orfs subjected to analysis with two panels of sera representing different stages of infection. Three types of data supported this conclusion: the magnitude of sign differences between pairs of LB patient sera with control sera (see Table 2), the number of Orfs with corrected, regularized P values <0.01, and number of Orfs with areas under the ROC curve that exceeded the upper confidence limit for random expectations (see Table 5). Of this larger set of immunogens, ~100 were broadly enough reactive across several LB serum samples that they could be used to distinguish groups of infected individuals from groups of controls. This interpretation also seemed to hold true for white-footed mice, which generally recognized the same subset of proteins as humans. The absolute number of distinct (i.e., non-cross-reactive) antigens is probably less than the first accounting suggested, because of the heavy representation of proteins in PFs on the immunogen list (Table 1). The several Bdr proteins on the list could probably be replaced in an array by one or two Bdr proteins with no loss of sensitivity.

unknown antigens appear to be as informative as other proteins, such as FlaB, OspC, P66, BmpA, and VlsE, that have established value for LB serodiagnosis. In addition, in this study we also rediscovered several other proteins that may have been observed in a limited number of studies to be immunogenic in either natural or experimental infections but whose value had not been confirmed or which had not been further developed. Among these are the Bdr proteins.

The list of immunogenic proteins identified by proteome array analysis was compared with lists of genes that were more highly expressed under various conditions simulating infection in the natural hosts and were reported by Revel et al. (74), Ojaimi et al. (67), Brooks et al. (13), and Tokarz et al. (88). The concurrence between the proteome list and the four DNA array lists was greatest for the study of Revel et al., and accordingly, this study was the study used for comparison. Revel et al. employed three experimental conditions: (i) 23° C. and pH 7.4 in broth medium, which represented the environment in the unfed tick; (ii) 37° C. and pH 6.8 in broth medium, which represented the environment in ticks as they are feeding on a host and transmitting *B. burgdorferi*; and (iii) a dialysis chamber in the peritoneum of rats. Of the 79 Orfs that showed a 2-fold increase in mRNA under fed-tick conditions in comparison to unfed-tick conditions, the following 23 (29%) were among the high-ranking immunogens: BB0323, BB0329, BB0365, BB0668, BB0681, BB0844, BBA03, BBA07, BBA25, BBA34, BBA36, BBA66, BBB19, BBI42, BBK07, BBK13, BBK32, BBK53, BBL40, BBM27, BBO40, BBP39, and BBQ03. Four of these Orfs are encoded

TABLE 2

Pairwise comparisons of reactivities of sera with proteome array of *B. burgdorferi*

| Reference clinical group | n | Controls Mean (95% CI) differences in sign between serum pairs[a] | P[b] | Early LB Mean (95% CI) differences in sign between serum pairs[a] | P[b] | Later LB Mean (95% CI) differences in sign between serum pairs[a] | P[b] |
|---|---|---|---|---|---|---|---|
| Controls | 18 | | | −7.1 (−32 to 18) | 0.5 | −188 (−217 to −159) | <10$^{-5}$ |
| Early LB | 24 | −7 (−37 to 23) | 0.9 | | | −198 (−213 to −184) | <10$^{-6}$ |
| Later LB | 19 | 106 (36 to 177) | <10$^{-5}$ | 109 (35 to 184) | <10$^{-5}$ | | |

[a]The sera were panel 1 sera from controls and from patients with early and later LB. CI, confidence interval.
[b]Determined by the exact Wilcoxon signed-rank test.

The question of the minimal set of antigens necessary for discrimination between sera from patients and sera from controls was also addressed by the ROC curve analysis (FIG. 7). The introduction of increasing levels of noise provided a rough simulation of applying an assay in practice (that is, in different locations, at different times, and with different operators). It also allowed assessment of the effect of different amounts of heterogeneity in the total population. By this measure, 25 antigens provided more robustness in the face of increasing noise than 2 or 5 antigens, while expansion of the set to 45 antigens provided marginal if any advantage over 25 antigens.

To sum up, it was determined that proteins that detectably elicit antibodies during natural infection constitute about 15% of the polypeptides that might be expressed. In certain embodiments, incorporation of 2% of the total Orfs in an assay appears to be sufficient to provide very high levels of sensitivity and specificity. The attention now turns to what the high-value immunogens are. In the course of this study, it was discovered that several protein antigens of *B. burgdorferi* that have promise for serodiagnosis of LB but which were unappreciated as immunogens during infection. These previously by the 1p36 plasmid. Among the 19 Orfs whose expression was found by Revel et al. to significantly increase in dialysis chambers in comparison to conditions mimicking unfed ticks, 5 (26%) were on the antigen list. The only three Orfs whose expression decreased under conditions associated with mammalian infection were BBA15 (OspA) and BBA16 (OspB), whose expression was known to decrease in the fed ticks and during early infections in mammals (32, 80, 81), and BB0385 (BmpD). Thus, there was an association between the upregulation of genes in the fed ticks and mammals and the immunogenicity of the gene products in infected humans.

Western blots of two-dimensional electrophoresis gels provide greater resolution than one-dimensional gels and allow detection of less abundant immunogens in lysates. Nowalk et al. performed such an proteomic analysis with the same samples that constituted serum panel 1 (66). Fifteen of the 21 proteins identified by Nowalk et al. as immunogens were also high-ranking Orfs in the present study. These proteins include four Erp proteins (BBL39, BBL40, BBN38, and BBP39), three oligopeptide ABC transporters belonging to PF 37 (BB0328, BB0329, and BBB16), two PF 54 proteins (BBA64 and BBA66), a RevA protein (BBM27), and the unique hypothetical protein BBA03, as well as the established antigens BB0147 (FlaB), BB0365 (LA7), BB0603 (P66), and BBA15 (OspA).

The large number of proteins newly identified as immunogenic precludes discussion of each of them in depth here. Instead, we limit our remarks to the Bdr proteins (PF 113), flagellar apparatus proteins, and BBK07 and BBK12, the two members of PF 59. Of all the PF proteins, the Bdr proteins were the most prevalent among the Orfs shown in Table 1. It was previously reported that LB patients, but not controls, had antibodies to some of the Bdr proteins (99), but in that study we did not include BdrT (BBG33), the highest-ranked Bdr protein here. While proteins in PFs tend in general to be more immunogenic than other non-PF Orfs, if only because of their multiple versions in a cell, the Bdr proteins may be doubly immunogenic because they have intramolecular repeats as well (98). The number of copies of the peptide TKIDWVEKNLQKD or a variation of this peptide in a Bdr sequence determines the size of the protein. The BBG33 protein, which is 266 amino acids long, is the largest Bdr protein encoded by the B31 genome. Most of the other Bdr proteins are less than 200 residues long. If the internal repeats are immunodominant epitopes, then BdrT would display more of these repeats for the binding of antibodies than other Bdr proteins and, consequently, generate higher spot intensities. The coefficient for BBL27 regressed on BBG33 is 0.86, and the y intercept is −0.29 (FIG. 3), an indication of lower levels of binding across all sera to the shorter Bdr. BdrT, also called BdrF2, has been reported to be upregulated in "host-adapted" *B. burgdorferi* and to be specifically expressed during early infection in mice (75, 97).

This study revealed that several flagellar apparatus proteins besides FlaB flagellin (BB0147), the FlgE hook protein (BB0283), and the FlaA protein (BB0668) (42, 51, 69, 77) elicit antibody responses during infection. Brinkmann et al. found that FlgE of *T. pallidum* was frequently bound by antibodies in sera from patients with syphilis (11). FliL (BB0279) stood out among this larger group of flagellar antigens because of the frequency with which it was recognized by both human and white-footed mouse serum. Indeed, the field mice had antibody to FliL more frequently than they had antibody to FlaB, the long-standing flagellar antigen of choice for diagnosis. FliL has 178 residues and is the flagellar basal body-associated protein, which as an inner membrane protein interacts with the cytoplasmic ring of the basal body of the flagellum apparatus. Among all organisms, the most similar proteins outside the genus *Borrelia* are the FliL proteins of *T. pallidum, Treponema denticola*, and *Leptospira interrogans*, but the sequence identities with the proteins of these other spirochete species are less than 35%. In comparison, the FlaB protein of *B. burgdorferi* is 40% identical to the homologous flagellin proteins of *Treponema* spp. As a component of an immunoassay, FliL may show less antigenic cross-reactivity with the homologous proteins of other bacteria than has been the case with FlaB (59, 73). Of all the newly identified Orfs, the most attention was paid to BBK07 and BBK12. As determined by stringent criteria, these are predicted lipoproteins, and although the amino acid sequences are 88% identical, the ORFs are located several ORFs apart in the left arm of the 1p36 plasmid. Comparison of the BBK07 and BBK12 gene sequences of strain B31 with the sequences of two other strains, 297 and N40, revealed >98% sequence identity between the strains for these sequences, an indication that a single example of each could be used to detect antibodies to other strains of *B. burgdorferi*. Although BBK12 and, by inference, BBK07 are expressed by cells cultivated in the laboratory (FIG. 6), neither had previously been identified as an antigen. This may be attributable in part to the tendency of the 1p36 plasmid to be lost sooner than other plasmids from *B. burgdorferi* during serial cultivation (7, 72, 79); thus, this plasmid may have frequently been absent from the lysates that investigators used for Western blotting and other fractionations in pursuit of diagnostic antigens. But another reason why BBK12 and BBK07 may have been overlooked is that these genes appear to be unique to *B. burgdorferi*. They have not been found to date in the two other major Lyme disease agents: *Borrelia afzelii* and *Borrelia garinii*. Using a DNA array comprising various lipoprotein genes of *B. burgdorferi*, Liang et al. did not find evidence of the BBK07 and BBK12 genes in either *B. afzelii* or *B. garinii* (55). Glockner et al. reported that they "did not find counterparts of the *B. burgdorferi* plasmids 1p36 and 1p38 or their respective gene repertoire in the *B. garinii* genome" (43). Searches of all deposited GenBank sequences of *B. garinii* and *B. afzelii*, including two genomes of each species, likewise did not reveal a PF 59 ortholog. As determined by this analysis, the 1p34 plasmid of *B. afzelii* has orthologs of *B. burgdorferi* ORFs in the order BBK01-BBK13-BBK15-BBK17-BBK21-BBK22-BBK23-BBK24, but BBK07 and BBK12 are absent from this and other replicons. If this genetic difference between LB species is confirmed, it suggests that BBK07 or BBK12 can be used in serological assays to distinguish *B. burgdorferi* infections from *B. afzelii* and *B. garinii* infections. These genetic distinctions between lineages may also provide insight into differences in pathogenesis and clinical manifestations between LB species.

Estimation of the number of immunogenic Orfs. The size of the set of proteins that were immunogenic in *B. burgdorferi* infections was assessed by examining the relative amounts of binding for antibodies in panel 1 serum specimens and each of the 1,292 strain B31 Orfs. To do this, the sign for each possible pair of sera in the panel was determined. The member of a pair that had the higher intensity value for a given Orf was assigned a value of "1," and the pair member with lower reactivity was assigned a value of "0." As a hypothetical example, if serum a had an intensity value of 3,246 for Orf x and serum b had a value of 1,711 for Orf x, then serum a was assigned a value of "1" and serum b was assigned a value of "0" for the pairwise comparison in the matrix.

Under the null hypothesis, a given serum sample would have the higher value of the pair in one-half of the comparisons, or 646 comparisons in this case. This was observed when controls were compared to controls, early-infection sera were compared to early-infection sera, and later-infection sera were compared to later-infection sera; the observed mean values were 646 (95% confidence interval, 482 to 810), 646 (95% confidence interval, 524 to 768), and 646 (95% confidence interval, 505 to 787), respectively. In contrast to these results for within-group pairs were the results for between-group pairs, e.g., a control serum and an LB serum. Table 2 summarizes the intergroup comparisons. Excess binding in the range from 100 to 200 Orfs was also observed with later-infection sera compared to early-infection sera. From these results, it was estimated that the upper limit for immunogenic Orfs during human infection was 200, or 15% of the 1,292 strain B31 Orfs on the array.

Figure 8:
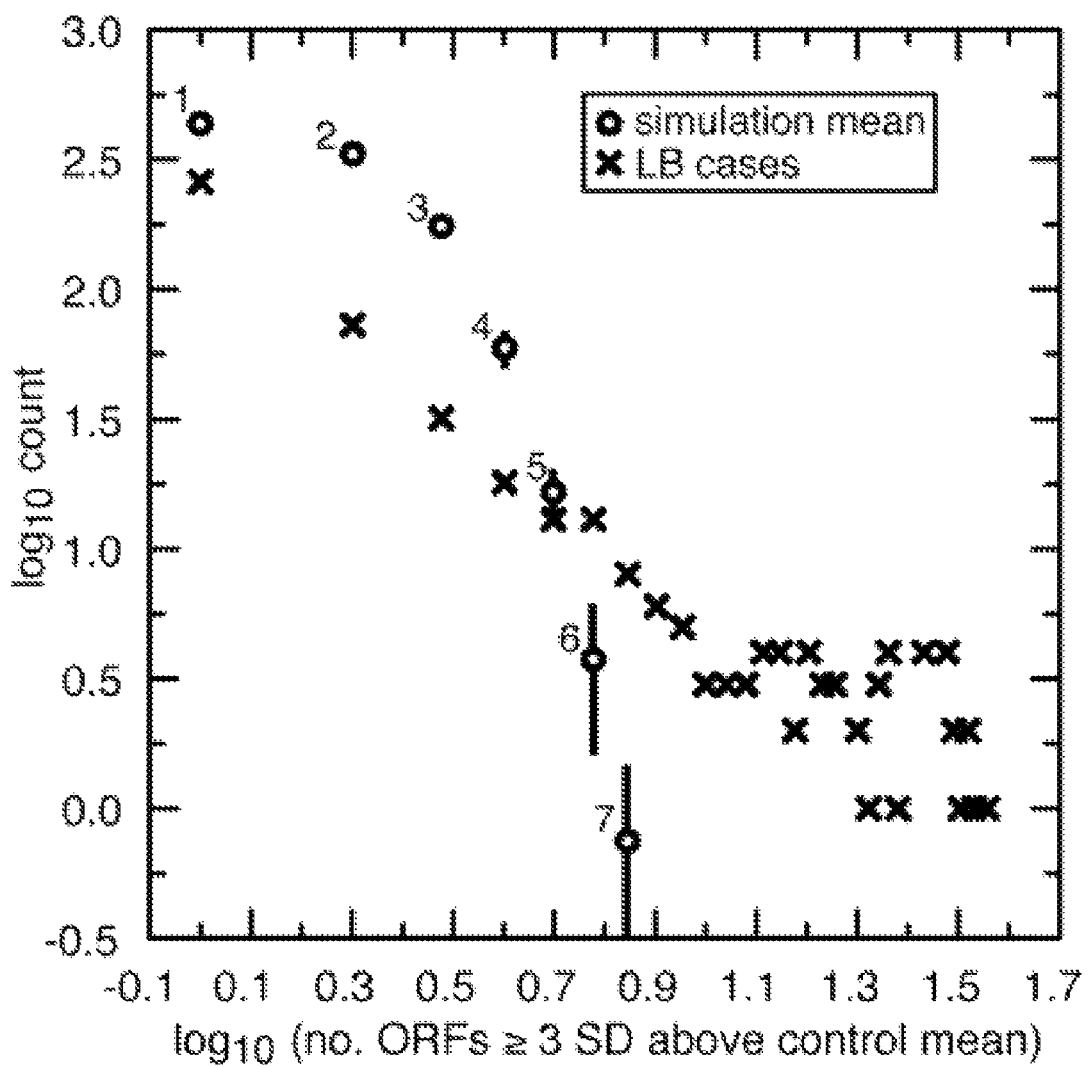
FIG. 8 shows a comparison of observed results with expected results from simulations: counts of Orfs in arrays with LB sera that were 3 SDs above the mean of control sera one or more times. Results for 39 panel 1 and 2 sera from patients with later LB are compared with mean counts (with 95% confidence intervals) for four simulation runs with random linkages. The numbers of Orfs that exceeded the 3-SD cutoff one to seven times are indicated next to the corresponding symbols for the random linkage simulation.

Simulation to establish a cutoff frequency. The mean and SD for each Orf with all control serum samples in each panel were determined. Then, for each Orf and for every serum sample in each panel, the number of SDs above or below the mean for the control sera in the same serum panel for the Orf in question was determined for normalization. For each sample all the Orfs that had array spots with values that were 3 SDs above the mean for the negative controls in the experiment for the given Orf were tabulated and summed. The frequencies of each Orf that appeared in this cumulative list were then determined. To provide an exact test of the significance of the counts that were obtained, the linkages were randomized for a given normalized value and an Orf and then likewise counted the times that an Orf was associated by chance with an SD that was 3 above the controls. This gave an estimate of the distribution under random conditions. Four replicates were performed, and the means were used to provide a distribution under the null hypothesis of random association between SD and Orf. FIG. 8 shows the means and confidence intervals for the four replicates, i.e., what was expected under random expectations. This is compared to what we observed with 39 sera from patients with later LB.

REFERENCES

1. Aguero-Rosenfeld, M. E., G. Wang, I. Schwartz, and G. P. Wormser. 2005. Diagnosis of lyme borreliosis. Clin. Microbiol. Rev. 18:484-509.
2. Altman, D. G., D. Machin, T. N. Bryant, and M. J. Gardner. 2000. Statistics with confidence. BMJ Books, London, United Kingdom.
3. Baldi, P., and H. G. Hatfield. 2002. DNA microarrays and gene expression: from experiments to data analysis and modeling. Cambridge University Press, Cambridge, United Kingdom.
4. Baldi, P., and A. D. Long. 2001. A Bayesian framework for the analysis of microarray expression data: regularized t-test and statistical inferences of gene changes. Bioinformatics 17:509-519.
5. Barbour, A. G. 1984. Immunochemical analysis of Lyme disease spirochetes. Yale J. Biol. Med. 57:581-586.
6. Barbour, A. G. 1984. Isolation and cultivation of Lyme disease spirochetes. Yale J. Biol. Med. 57:521-525.
7. Barbour, A. G. 1988. Plasmid analysis of *Borrelia burgdorferi*, the Lyme disease agent. J. Clin. Microbiol. 26:475-478.
8. Barbour, A. G., W. Burgdorfer, E. Grunwaldt, and A. C. Steere. 1983. Antibodies of patients with Lyme disease to components of the Ixodes dammini spirochete. J. Clin. Investig. 72:504-515.
9. Barbour, A. G., S. F. Hayes, R. A. Heiland, M. E. Schrumpf, and S. L. Tessier. 1986. A *Borrelia*-specific monoclonal antibody binds to a flagellar epitope. Infect. Immun. 52:549-554.
10. Barbour, A. G., S. L. Tessier, and W. J. Todd. 1983. Lyme disease spirochetes and ixodid tick spirochetes share a common surface antigenic determinant defined by a monoclonal antibody. Infect. Immun. 41:795-804.
11. Brinkman, M. B., M. McKevitt, M. McLoughlin, C. Perez, J. Howell, G. M. Weinstock, S. J. Norris, and T. Palzkill. 2006. Reactivity of antibodies from syphilis patients to a protein array representing the *Treponema pallidum* proteome. J. Clin. Microbiol. 44:888-891.
12. Brisson, D., and D. E. Dykhuizen. 2004. ospC diversity in *Borrelia burgdorferi*: different hosts are different niches. Genetics 168:713-722.
13. Brooks, C. S., P. S. Hefty, S. E. Jolliff, and D. R. Akins 2003. Global analysis of *Borrelia burgdorferi* genes regulated by mammalian host-specific signals. Infect. Immun. 71:3371-3383.
14. Bunikis, J., and A. G. Barbour. 2002. Laboratory testing for suspected Lyme disease. Med. Clin. N. Am. 86:311-340.
15. Bunikis, J., U. Garpmo, J. Tsao, J. Berglund, D. Fish, and A. G. Barbour. 2004. Sequence typing reveals extensive strain diversity of the Lyme borreliosis agents *Borrelia burgdorferi* in North America and *Borrelia afzelii* in Europe. Microbiology 150:1741-1755.
16. Bunikis, J., C. J. Luke, E. Bunikiene, S. Bergstrom, and A. G. Barbour. 1998. A surface-exposed region of a novel outer membrane protein (P66) of *Borrelia* spp. is variable in size and sequence. J. Bacteriol. 180:1618-1623.
17. Bunikis, J., L. Noppa, Y. Ostberg, A. G. Barbour, and S. Bergstrom. 1996. Surface exposure and species specificity of an immunoreactive domain of a 66-kilodalton outer membrane protein (P66) of the *Borrelia* spp. that cause Lyme disease. Infect. Immun. 64:5111-5116.
18. Bunikis, J., J. Tsao, C. J. Luke, M. G. Luna, D. Fish, and A. G. Barbour. 2004. *Borrelia burgdorferi* infection in a natural population of *Peromyscus leucopus* mice: a longitudinal study in an area where Lyme borreliosis is highly endemic. J. Infect. Dis. 189:1515-1523.
19. Burgdorfer, W., A. G. Barbour, S. F. Hayes, J. L. Benach, E. Grunwaldt, and J. P. Davis. 1982. Lyme disease—a tick-borne spirochetosis? Science 216:1317-1319.
20. Cadavid, D., P. M. Pennington, T. A. Kerentseva, S. Bergstrom, and A. G. Barbour. 1997. Immunologic and genetic analyses of VmpA of a neurotropic strain of *Borrelia turicatae*. Infect. Immun. 65:3352-3360.
21. Casjens, S., N. Palmer, R. van Vugt, W. M. Huang, B. Stevenson, P. Rosa, R. Lathigra, G. Sutton, J. Peterson, R. J. Dodson, D. Haft, E. Hickey, M. Gwinn, O. White, and C. M. Fraser. 2000. A bacterial genome in flux: the twelve linear and nine circular extrachromosomal DNAs in an infectious isolate of the Lyme disease spirochete *Borrelia burgdorferi*. Mol. Microbiol. 35:490-516.
22. Coleman, S. A., E. R. Fischer, D. C. Cockrell, D. E. Voth, D. Howe, D. J. Mead, J. E. Samuel, and R. A. Heinzen. 2007. Proteome and antigen profiling of *Coxiella burnetii* developmental forms. Infect. Immun. 75:290-298.
23. Connolly, J. P., D. Comerci, T. G. Alefantis, A. Walz, M. Quan, R. Chafin, P. Grewal, C. V. Mujer, R. A. Ugalde, and V. G. DelVecchio. 2006. Proteomic analysis of Brucella abortus cell envelope and identification of immunogenic candidate proteins for vaccine development. Proteomics 6:3767-3780.
24. Craft, J. E., D. K. Fischer, G. T. Shimamoto, and A. C. Steere. 1986. Antigens of *Borrelia burgdorferi* recognized during Lyme disease. Appearance of a new immunoglobulin M response and expansion of the immunoglobulin G response late in the illness. J. Clin. Investig. 78:934-939.
25. Crother, T. R., C. I. Champion, J. P. Whitelegge, R. Aguilera, X. Y. Wu, D. R. Blanco, J. N. Miller, and M. A. Lovett. 2004. Temporal analysis of the antigenic composition of *Borrelia burgdorferi* during infection in rabbit skin. Infect. Immun. 72:5063-5072.
26. Crotty, S., P. Felgner, H. Davies, J. Glidewell, L. Villarreal, and R. Ahmed. 2003. Cutting edge: long-term B cell memory in humans after smallpox vaccination. J. Immunol. 171:4969-4973.
27. Daily, J. P., K. G. Le Roch, O. San, D. Ndiaye, A. Lukens, Y. Zhou, O. Ndir, S. Mboup, A. Sultan, E. A. Winzeler, and D. F. Wirth. 2005. In vivo transcriptome of Plasmodium falciparum reveals overexpression of transcripts that encode surface proteins. J. Infect. Dis. 191:1196-1203.
28. Das, S., D. Shraga, C. Gannon, T. T. Lam, S. Feng, L. R. Brunet, S. R. Telford, S. W. Barthold, R. A. Flavell, and E. Fikrig. 1996. Characterization of a 30-kDa *Borrelia burgdorferi* substrate-binding protein homologue. Res. Microbiol. 147:739-751.
29. Davies, D. H., X. Liang, J. E. Hernandez, A. Randall, S. Hirst, Y. Mu, K. M. Romero, T. T. Nguyen, M. Kalantari- 29. Dehaghi, S. Crotty, P. Baldi, L. P. Villarreal, and P. L. Felgner. 2005. Profiling the humoral immune response to infection by using proteome microarrays: high-throughput vaccine and diagnostic antigen discovery. Proc. Natl. Acad. Sci. USA 102:547-552.
30. Davies, D. H., M. M. McCausland, C. Valdez, D. Huynh, J. E. Hernandez, Y. Mu, S. Hirst, L. Villarreal, P. L. Felgner, and S. Crotty. 2005. Vaccinia virus H3L envelope protein is a major target of neutralizing antibodies in humans and elicits protection against lethal challenge in mice. J. Virol. 79:11724-11733.
31. Davies, D. H., D. M. Molina, J. Wrammert, J. Miller, S. Hirst, Y. Mu, J. Pablo, B. Unal, R. Nakajima-Sasaki, X. Liang, S. Crotty, K. L. Karem, I. K. Damon, R. Ahmed, L. Villarreal, and P. L. Feigner. 2007. Proteome-wide analysis of the serological response to vaccinia and smallpox. Proteomics 7:1678-1686.
32. de Silva, A. M., and E. Fikrig. 1997. Arthropod- and host-specific gene expression by *Borrelia burgdorferi*. J. Clin. Investig. 99:377-379.
33. Dressler, F., J. A. Whalen, B. N. Reinhardt, and A. C. Steere. 1993. Western blotting in the serodiagnosis of Lyme disease. J. Infect. Dis. 167:392-400.
34. Engstrom, S. M., E. Shoop, and R. C. Johnson. 1995. Immunoblot interpretation criteria for serodiagnosis of early Lyme disease. J. Clin. Microbiol. 33:419-427.
35. Eyles, J. E., B. Unal, M. G. Hartley, S. L. Newstead, H. Flick-Smith, J. L. Prior, P. C. Oyston, A. Randall, Y. Mu, S. Hirst, D. M. Molina, D. H. Davies, T. Milne, K. F. Griffin, P. Baldi, R. W. Titball, and P. L. Feigner. 2007. Immunodominant *Francisella tularensis* antigens identified using proteome microarray. Crown copyright 2007 Dstl. Proteomics 7:2172-2183.
36. Feng, S., S. Das, T. Lam, R. A. Flavell, and E. Fikrig. 1995. A 55-kilodalton antigen encoded by a gene on a *Borrelia burgdorferi* 49-kilobase plasmid is recognized by antibodies in sera from patients with Lyme disease. Infect. Immun. 63:3459-3466.
37. Feng, S., E. Hodzic, B. Stevenson, and S. W. Barthold. 1998. Humoral immunity to *Borrelia burgdorferi* N40 decorin binding proteins during infection of laboratory mice. Infect. Immun. 66:2827-2835.
38. Forgber, M., R. Basu, K. Roychoudhury, S. Theinert, S. Roy, S. Sundar, and P. Walden. 2006. Mapping the antigenicity of the parasites in *Leishmania donovani* infection by proteome serology. PLoS ONE 1:e40.
39. Fraser et al., 1997. Genomic sequence of a Lyme disease spirochaete, *Borrelia burgdorferi*. Nature 390: 580-586.
40. Gardy, J. L., M. R. Laird, F. Chen, S. Rey, C. J. Walsh, M. Ester, and F. S. Brinkman. 2005. PSORTb v. 2.0: expanded prediction of bacterial protein subcellular localization and insights gained from comparative proteome analysis. Bioinformatics 21:617-623.
41. Gilmore, R. D., Jr., and M. L. Mbow. 1998. A monoclonal antibody generated by antigen inoculation via tick bite is reactive to the *Borrelia burgdorferi* Rev protein, a member of the 2.9 gene family locus. Infect. Immun. 66:980-986.
42. Gilmore, R. D., Jr., R. L. Murphree, A. M. James, S. A. Sullivan, and B. J. Johnson. 1999. The *Borrelia burgdorferi* 37-kilodalton immunoblot band (P37) used in serodiagnosis of early Lyme disease is the flaA gene product. J. Clin. Microbiol. 37:548-552.
43. Glockner, G., R. Lehmann, A. Romualdi, S. Pradella, U. Schulte-Spechtel, M. Schilhabel, B. Wilske, J. Suhnel, and M. Platzer. 2004. Comparative analysis of the *Borrelia garinii* genome. Nucleic Acids Res. 32:6038-6046.
44. Haas, G., G. Karaali, K. Ebermayer, W. G. Metzger, S. Lamer, U. Zimny-Arndt, S. Diescher, U. B. Goebel, K. Vogt, A. B. Roznowski, B. J. Wiedenmann, T. F. Meyer, T. Aebischer, and P. R. Jungblut. 2002. Immunoproteomics of *Helicobacter pylori* infection and relation to gastric disease. Proteomics 2:313-324.
45. Hansen, K., P. Hindersson, and N. S. Pedersen. 1988. Measurement of antibodies to the *Borrelia burgdorferi* flagellum improves serodiagnosis in Lyme disease. J. Clin. Microbiol. 26:338-346.
46. Heikkila, T., I. Seppala, H. Saxen, J. Panelius, H. Yrjanainen, and P. Landenne. 2002. Species-specific serodiagnosis of Lyme arthritis and neuroborreliosis due to *Borrelia burgdorferi* sensu stricto, *B. afzelii*, and *B. garinii* by using decorin binding protein A. J. Clin. Microbiol. 40:453-460.
47. Hochberg, Y., and Y. Benjamini. 1990. More powerful procedures for multiple significance testing. Stat. Med. 9:811-818.
48. Howe, T. R., L. W. Mayer, and A. G. Barbour. 1985. A single recombinant plasmid expressing two major outer surface proteins of the Lyme disease spirochete. Science 227:645-646.
49. Jewett, M. W., K. Lawrence, A. C. Bestor, K. Tilly, D. Grimm, P. Shaw, M. VanRaden, F. Gherardini, and P. A. Rosa. 2007. The critical role of the linear plasmid 1p36 in the infectious cycle of *Borrelia burgdorferi*. Mol. Microbiol. 64:1358-1374.
50. Johnson, B. J., K. E. Robbins, R. E. Bailey, B. L. Cao, S. L. Sviat, R. B. Craven, L. W. Mayer, and D. T. Dennis. 1996. Serodiagnosis of Lyme disease: accuracy of a two-step approach using a flagella-based ELISA and immunoblotting. J. Infect. Dis. 174:346-353.
51. Jwang, B., P. Dewing, E. Fikrig, and R. A. Flavell. 1995. The hook protein of *Borrelia burgdorferi*, encoded by the flgE gene, is serologically recognized in Lyme disease. Clin. Diagn. Lab Immunol. 2:609-615.
52. Kowalczewska, M., F. Fenollar, D. Lafitte, and D. Raoult. 2006. Identification of candidate antigen in Whipple's disease using a serological proteomic approach. Proteomics 6:3294-3305.
53. Lam, T. T., T. P. Nguyen, E. Fikrig, and R. A. Flavell. 1994. A chromosomal *Borrelia burgdorferi* gene encodes a 22-kilodalton lipoprotein, P22, that is serologically recognized in Lyme disease. J. Clin. Microbiol. 32:876-883.
54. Lawrenz, M. B., J. M. Hardham, R. T. Owens, J. Nowakowski, A. C. Steere, G. P. Wormser, and S. J. Norris. 1999. Human antibody responses to VlsE antigenic variation protein of *Borrelia burgdorferi*. J. Clin. Microbiol. 37:3997-4004.
55. Liang, F. T., F. K. Nelson, and E. Fikrig. 2002. DNA microarray assessment of putative *Borrelia burgdorferi* lipoprotein genes. Infect. Immun. 70:3300-3303.
56. Liang, F. T., A. C. Steere, A. R. Marques, B. J. Johnson, J. N. Miller, and M. T. Philipp. 1999. Sensitive and specific serodiagnosis of Lyme disease by enzyme-linked immunosorbent assay with a peptide based on an immunodominant conserved region of *Borrelia burgdorferi* vlsE. J. Clin. Microbiol. 37:3990-3996.
57. Lu, Z., M. I. Roche, J. H. Hui, B. Unal, P. L. Felgner, S. Gulati, G. Madico, and J. Sharon. 2007. Generation and characterization of hybridoma antibodies for immunotherapy of tularemia. Immunol. Lett. 112:92-103.
58. Luft, B. J., P. D. Gorevic, W. Jiang, P. Munoz, and R. J. Dattwyler. 1991. Immunologic and structural characterization of the dominant 66- to 73-kDa antigens of *Borrelia burgdorferi*. J. Immunol. 146:2776-2782.

59. Magnarelli, L. A., E. Fikrig, S. J. Padula, J. F. Anderson, and R. A. Flavell. 1996. Use of recombinant antigens of *Borrelia burgdorferi* in serologic tests for diagnosis of Lyme borreliosis. J. Clin. Microbiol. 34:237-240.

60. McAtee, C. P., K. E. Fry, and D. E. Berg. 1998. Identification of potential diagnostic and vaccine candidates of *Helicobacter pylori* by "proteome" technologies. *Helicobacter* 3:163-169.

61. McKevitt, M., M. B. Brinkman, M. McLoughlin, C. Perez, J. K. Howell, G. M. Weinstock, S. J. Norris, and T. Palzkill. 2005. Genome scale identification of *Treponema pallidum* antigens. Infect. Immun. 73:4445-4450.

62. Meier, J. T., M. I. Simon, and A. G. Barbour. 1985. Antigenic variation is associated with DNA rearrangements in a relapsing fever *Borrelia*. Cell 41:403-409.

63. Miller, J. C., and B. Stevenson. 2003. Immunological and genetic characterization of *Borrelia burgdorferi* BapA and EppA proteins. Microbiology 149: 1113-1125.

64. Nigrovic, L. E., and K. M. Thompson. 2007. The Lyme vaccine: a cautionary tale. Epidemiol. Infect. 135:1-8.

65. Nowalk, A. J., R. D. Gilmore, Jr., and J. A. Carroll. 2006. Serologic proteome analysis of *Borrelia burgdorferi* membrane-associated proteins. Infect. Immun. 74:3864-3873.

66. Nowalk, A. J., C. Nolder, D. R. Clifton, and J. A. Carroll. 2006. Comparative proteome analysis of subcellular fractions from *Borrelia burgdorferi* by NEPHGE and IPG. Proteomics 6:2121-2134.

67. Ojaimi, C., C. Brooks, D. Akins, S. Casjens, P. Rosa, A. Elias, A. Barbour, A. Jasinskas, J. Benach, L. Katonah, J. Radolf, M. Caimano, J. Skare, K. Swingle, S. Sims, and I. Schwartz. 2002. *Borrelia burgdorferi* gene expression profiling with membrane-based arrays. Methods Enzymol. 358:165-177.

68. Padula, S. J., A. Sampieri, F. Dias, A. Szczepanski, and R. W. Ryan. 1993. Molecular characterization and expression of p23 (OspC) from a North American strain of *Borrelia burgdorferi*. Infect. Immun. 61:5097-5105.

69. Panelius, J., P. Landenne, H. Saxen, T. Heikkila, and I. Seppala. 2001. Recombinant flagellin A proteins from *Borrelia burgdorferi* sensu stricto, *B. afzelii*, and *B. garinii* in serodiagnosis of Lyme borreliosis. J. Clin. Microbiol. 39:4013-4019.

70. Porcella, S. F., C. A. Fitzpatrick, and J. L. Bono. 2000. Expression and immunological analysis of the plasmid-borne mlp genes of *Borrelia burgdorferi* strain B31. Infect. Immun. 68:4992-5001.

71. Probert, W. S., and B. J. Johnson. 1998. Identification of a 47 kDa fibronectin-binding protein expressed by *Borrelia burgdorferi* isolate B31. Mol. Microbiol. 30:1003-1015.

72. Purser, J. E., and S. J. Norris. 2000. Correlation between plasmid content and infectivity in *Borrelia burgdorferi*. Proc. Natl. Acad. Sci. USA 97:13865-13870.

73. Rasiah, C., E. Schiltz, J. Reichert, and A. Vogt. 1992. Purification and characterization of a tryptic peptide of *Borrelia burgdorferi* flagellin, which reduces cross-reactivity in immunoblots and ELISA. J. Gen. Microbiol. 138: 147-154.

74. Revel, A. T., A. M. Talaat, and M. V. Norgard. 2002. DNA microarray analysis of differential gene expression in *Borrelia burgdorferi*, the Lyme disease spirochete. Proc. Natl. Acad. Sci. USA 99:1562-1567.

75. Roberts, D. M., M. Caimano, J. McDowell, M. Theisen, A. Holm, E. Orff, D. Nelson, S. Wikel, J. Radolf, and R. T. Marconi. 2002. Environmental regulation and differential production of members of the Bdr protein family of *Borrelia burgdorferi*. Infect. Immun. 70:7033-7041.

76. Roberts, W. C., B. A. Mullikin, R. Lathigra, and M. S. Hanson. 1998. Molecular analysis of sequence heterogeneity among genes encoding decorin binding proteins A and B of *Borrelia burgdorferi* sensu lato. Infect. Immun. 66:5275-5285.

77. Sadziene, A., D. D. Thomas, V. G. Bundoc, S. C. Holt, and A. G. Barbour. 1991. A flagella-less mutant of *Borrelia burgdorferi*. Structural, molecular, and in vitro functional characterization. J. Clin. Investig. 88:82-92.

78. Saeed et al., 1988. Changes in infectivity and plasmid profile of the Lyme disease spirochete, *Borrelia burgdorferi*, as a result of in vitro cultivation. Infect. Immun. 56:1831-1836.

80. Schwan, T. G., and J. Piesman. 2000. Temporal changes in outer surface proteins A and C of the Lyme disease-associated spirochete, *Borrelia burgdorferi*, during the chain of infection in ticks and mice. J. Clin. Microbiol. 38:382-388.

81. Schwan, T. G., J. Piesman, W. T. Golde, M. C. Dolan, and P. A. Rosa. 1995. Induction of an outer surface protein on *Borrelia burgdorferi* during tick feeding. Proc. Natl. Acad. Sci. USA 92:2909-2913.

82. Steere, A. C., and S. M. Angelis. 2006. Therapy for Lyme arthritis: strategies for the treatment of antibiotic-refractory arthritis. Arthritis Rheum. 54:3079-3086.

83. Steere, A. C., J. Coburn, and L. Glickstein. 2004. The emergence of Lyme disease. J. Clin. Investig. 113:1093-1101.

84. Steere, A. C., G. McHugh, C. Suarez, J. Hoitt, N. Damle, and V. K. Sikand. 2003. Prospective study of coinfection in patients with erythema migrans. Clin. Infect. Dis. 36:1078-1081.

85. Stevenson, B., J. L. Bono, T. G. Schwan, and P. Rosa. 1998. *Borrelia burgdorferi* Erp proteins are immunogenic in mammals infected by tick bite, and their synthesis is inducible in cultured bacteria. Infect. Immun. 66:2648-2654.

86. Sundaresh, S., D. L. Doolan, S. Hirst, Y. Mu, B. Unal, D. H. Davies, P. L. Felgner, and P. Baldi. 2006. Identification of humoral immune responses in protein microarrays using DNA microarray data analysis techniques. Bioinformatics 22:1760-1766.

87. Sundaresh, S., A. Randall, B. Unal, J. M. Petersen, J. T. Belisle, M. G. Hartley, M. Duffield, R. W. Titball, D. H. Davies, P. L. Felgner, and P. Baldi. 2007. From protein microarrays to diagnostic antigen discovery: a study of the pathogen *Francisella tularensis*. Bioinformatics 23:i508-i518.

88. Tokarz, R., J. M. Anderton, L. I. Katona, and J. L. Benach. 2004. Combined effects of blood and temperature shift on *Borrelia burgdorferi* gene expression as determined by whole-genome DNA array. Infect. Immun. 72:5419-5432.

89. Truchon, J.-F., and C. I. Bayly. 2007. Evaluating virtual screening methods: good and bad metrics for the "early recognition" problem. J. Chem. Inf. Model. 47:488-508.

90. Tsao, J., A. G. Barbour, C. J. Luke, E. Fikrig, and D. Fish. 2001. OspA immunization decreases transmission of *Borrelia burgdorferi* spirochetes from infected *Peromyscus leucopus* mice to larval *Ixodes scapularis* ticks. Vector Borne Zoonotic Dis. 1:65-74.

91. Ulvestad, E., A. Kanestrom, L. J. Sonsteby, R. Jureen, T. Omland, B. Edvardsen, J. Lundervik, E. Kristoffersen, and A. P. van Dam. 2001. Diagnostic and biological significance of anti-p41 IgM antibodies against *Borrelia burgdorferi*. Scand. J. Immunol. 53:416-421.

92. Vapnik, V. 1995. The nature of statistical learning theory. Springer, New York, N.Y.

93. Vaz, A., L. Glickstein, J. A. Field, G. McHugh, V. K. Sikand, N. Damle, and A. C. Steere. 2001. Cellular and humoral immune responses to *Borrelia burgdorferi* antigens in patients with culture-positive early Lyme disease. Infect. Immun. 69:7437-7444.
94. Wallich, R., M. M. Simon, H. Hofmann, S. E. Moter, U. E. Schaible, and M. D. Kramer. 1993. Molecular and immunological characterization of a novel polymorphic lipoprotein of *Borrelia burgdorferi*. Infect. Immun. 61:4158-4166.
95. Wharton, M., T. L. Chorba, R. L. Vogt, D. L. Morse, and J. W. Buehler. 1990. Case definitions for public health surveillance. MMWR Recomm. Rep. 39:1-43.
96. Wilske, B., V. Fingerle, P. Herzer, A. Hofmann, G. Lehnert, H. Peters, H. W. Pfister, V. Preac-Mursic, E. Soutschek, and K. Weber. 1993. Recombinant immunoblot in the serodiagnosis of Lyme borreliosis. Comparison with indirect immunofluorescence and enzyme-linked immunosorbent assay. Med. Microbiol. Immunol. 182:255-270.
97. Zhang, H., A. Raji, M. Theisen, P. R. Hansen, and R. T. Marconi. 2005. bdrF2 of Lyme disease spirochetes is coexpressed with a series of cytoplasmic proteins and is produced specifically during early infection. J. Bacteriol. 187:175-184.
98. Zuckert, W. R., and J. Meyer. 1996. Circular and linear plasmids of Lyme disease spirochetes have extensive homology: characterization of a repeated DNA element. J. Bacteriol. 178:2287-2298.
99. Zuckert, W. R., J. Meyer, and A. G. Barbour. 1999. Comparative analysis and immunological characterization of the *Borrelia* Bdr protein family. Infect. Immun. 67:3257-3266.

All publications and patents mentioned in the above specification are herein incorporated by reference. Various modifications and variations of the described method and system of the invention will be apparent to those skilled in the art without departing from the scope and spirit of the invention. Although the invention has been described in connection with specific preferred embodiments, it should be understood that the invention as claimed should not be unduly limited to such specific embodiments. Indeed, various modifications of the described modes for carrying out the invention which are obvious to those skilled in chemistry and molecular biology or related fields are intended to be within the scope of the following claims.

SEQUENCE LISTING (288 sequences)

SEQ ID NO: 1 - DNA, 20 bp, Artificial Sequence
  Synthetic
atgtcaataaaaacagtaaa

SEQ ID NO: 2 - DNA, 20 bp, Artificial Sequence
  Synthetic
attctccaaaaccttaatac

SEQ ID NO: 3 - DNA, 20 bp, Artificial Sequence
  Synthetic
atgaagagttttttattttg

SEQ ID NO: 4 - DNA, 20 bp, Artificial Sequence
  Synthetic
ttttagactagaatccaaga

SEQ ID NO: 5 - DNA, 20 bp, Artificial Sequence
  Synthetic
atgattatcaatcataatac

SEQ ID NO: 6 - DNA, 20 bp, Artificial Sequence
  Synthetic
tctaagcaatgacaaaacat

SEQ ID NO: 7 - DNA, 20 bp, Artificial Sequence
  Synthetic
gtggattcaacattttcagg

SEQ ID NO: 8 - DNA, 20 bp, Artificial Sequence
  Synthetic
tactcccattttatttatta

SEQ ID NO: 9 - DNA, 20 bp, Artificial Sequence
  Synthetic
ttgatgaaaaaagttattat

SEQ ID NO: 10 - DNA, 20 bp, Artificial Sequence
  Synthetic
tgtttttatccctaaaaagc

SEQ ID NO: 11 - DNA, 20 bp, Artificial Sequence
  Synthetic
gtgttaatggaggttcttat

SEQ ID NO: 12 - DNA, 20 bp, Artificial Sequence
  Synthetic
atttatggaagacaaaaacc

SEQ ID NO: 13 - DNA, 20 bp, Artificial Sequence
  Synthetic
ttgaaagggtttttagcgat

SEQ ID NO: 14 - DNA, 20 bp, Artificial Sequence
  Synthetic
aacatattgatctttttcat

SEQ ID NO: 15 - DNA, 20 bp, Artificial Sequence
  Synthetic
atgcctaataaagacgatga

SEQ ID NO: 16 - DNA, 20 bp, Artificial Sequence
  Synthetic
catatcaaaaatatcaattt

SEQ ID NO: 17 - DNA, 20 bp, Artificial Sequence
  Synthetic
atgatgaggtctttatattc

SEQ ID NO: 18 - DNA, 20 bp, Artificial Sequence
  Synthetic
atttttcaatcttacaagtt

SEQ ID NO: 19 - DNA, 20 bp, Artificial Sequence
  Synthetic
atgaaagtgaataatttttt

SEQ ID NO: 20 - DNA, 20 bp, Artificial Sequence
  Synthetic
ctccaatgaactaacagaca

SEQ ID NO: 21 - DNA, 20 bp, Artificial Sequence
  Synthetic
atgaatataaagaataaatt

SEQ ID NO: 22 - DNA, 20 bp, Artificial Sequence
  Synthetic
tttggcaggaattattatct

SEQ ID NO: 23 - DNA, 20 bp, Artificial Sequence
  Synthetic
atgaaatatataaaaatagc

SEQ ID NO: 24 - DNA, 20 bp, Artificial Sequence
  Synthetic
ttttttagttttaatatctt

SEQ ID NO: 25 - DNA, 20 bp, Artificial Sequence
  Synthetic
atgaaattacaaaggtcatt

SEQ ID NO: 26 - DNA, 20 bp, Artificial Sequence
  Synthetic
tttattttttaattttagct

SEQ ID NO: 27 - DNA, 20 bp, Artificial Sequence
  Synthetic
atgggttttcacatttatga

SEQ ID NO: 28 - DNA, 20 bp, Artificial Sequence
  Synthetic
tttttgtttaatagaataaa

SEQ ID NO: 29 - DNA, 20 bp, Artificial Sequence
  Synthetic
atgatttcaaagttaacaaa

SEQ ID NO: 30 - DNA, 20 bp, Artificial Sequence
  Synthetic
tatatttcgtcctttgattg

SEQ ID NO: 31 - DNA, 20 bp, Artificial Sequence
  Synthetic
atgaaaaataaatttttaat

SEQ ID NO: 32 - DNA, 20 bp, Artificial Sequence
  Synthetic
attacctaatttagacaaat

SEQ ID NO: 33 - DNA, 20 bp, Artificial Sequence
  Synthetic
atgtataaaaatggtttttt

SEQ ID NO: 34 - DNA, 20 bp, Artificial Sequence
  Synthetic
attcgttaacataggtgaaa

SEQ ID NO: 35 - DNA, 20 bp, Artificial Sequence
  Synthetic
atgttaaaaaaagtttatta

SEQ ID NO: 36 - DNA, 20 bp, Artificial Sequence
  Synthetic
attttccatttgcaaaacaa

SEQ ID NO: 37 - DNA, 20 bp, Artificial Sequence
  Synthetic
atgttttttaattttttgaa

SEQ ID NO: 38 - DNA, 20 bp, Artificial Sequence
  Synthetic
ttcagattcctttaatttta

SEQ ID NO: 39 - DNA, 20 bp, Artificial Sequence
  Synthetic
atgaaatttaggaggttagt

SEQ ID NO: 40 - DNA, 20 bp, Artificial Sequence
  Synthetic
ttccaatatctcaagaattc

SEQ ID NO: 41 - DNA, 20 bp, Artificial Sequence
  Synthetic
atgggcaaaataataggtat

SEQ ID NO: 42 - DNA, 20 bp, Artificial Sequence
  Synthetic
ttttttatcctcgtcaacaa

SEQ ID NO: 43 - DNA, 20 bp, Artificial Sequence
  Synthetic
ttgtatatgattaggcttaa

SEQ ID NO: 44 - DNA, 20 bp, Artificial Sequence
  Synthetic
cacaattccaaattcaaaac

SEQ ID NO: 45 - DNA, 20 bp, Artificial Sequence
  Synthetic
atgaaaagccatattttata

SEQ ID NO: 46 - DNA, 20 bp, Artificial Sequence
  Synthetic
gcttccgctgtaggctattt

SEQ ID NO: 47 - DNA, 20 bp, Artificial Sequence
  Synthetic
atggctaaagacatatattt

SEQ ID NO: 48 - DNA, 20 bp, Artificial Sequence
  Synthetic
catcattcccattcctgggt

SEQ ID NO: 49 - DNA, 20 bp, Artificial Sequence
  Synthetic
atgaaaaaaggatctaagct

SEQ ID NO: 50 - DNA, 20 bp, Artificial Sequence
  Synthetic
attactctttgcatattttg

SEQ ID NO: 51 - DNA, 20 bp, Artificial Sequence
  Synthetic
ttggtttacatgaaaaggaa

SEQ ID NO: 52 - DNA, 20 bp, Artificial Sequence
  Synthetic
atttttcggagatgattctt

SEQ ID NO: 53 - DNA, 20 bp, Artificial Sequence
  Synthetic
gtggttagtatgaagcttaa

SEQ ID NO: 54 - DNA, 20 bp, Artificial Sequence
  Synthetic
cttttcgatcttaaaataat

SEQ ID NO: 55 - DNA, 20 bp, Artificial Sequence
  Synthetic
ttggacttgttagatttact

SEQ ID NO: 56 - DNA, 20 bp, Artificial Sequence
  Synthetic
atctgcattgttgtgatgtt

SEQ ID NO: 57 - DNA, 20 bp, Artificial Sequence
  Synthetic
atgaacaaactaatgttgat

SEQ ID NO: 58 - DNA, 20 bp, Artificial Sequence
  Synthetic
attttggtttccatcaattt

SEQ ID NO: 59 - DNA, 20 bp, Artificial Sequence
  Synthetic
atgatgagagcattatggac

SEQ ID NO: 60 - DNA, 20 bp, Artificial Sequence
  Synthetic
ttgcctttttaagttatttg

SEQ ID NO: 61 - DNA, 20 bp, Artificial Sequence
  Synthetic
ttgaggaaaatattaaagtt

SEQ ID NO: 62 - DNA, 20 bp, Artificial Sequence
  Synthetic
ataatctttatctctaacaa

SEQ ID NO: 63 - DNA, 20 bp, Artificial Sequence
  Synthetic
atgaaatacttttatttttt

SEQ ID NO: 64 - DNA, 20 bp, Artificial Sequence
  Synthetic
ataatcttttaaaagcattt

SEQ ID NO: 65 - DNA, 20 bp, Artificial Sequence
  Synthetic
atgaaaaaaaaaaatttatc

SEQ ID NO: 66 - DNA, 20 bp, Artificial Sequence
  Synthetic
tttactcgtctctaaaaaat

SEQ ID NO: 67 - DNA, 20 bp, Artificial Sequence
  Synthetic
ttgaaaaaaacgattattgt

SEQ ID NO: 68 - DNA, 20 bp, Artificial Sequence
  Synthetic
tatagtgtctttaagtttat

SEQ ID NO: 69 - DNA, 20 bp, Artificial Sequence
  Synthetic
ttgaaaagagtcattgtatc

SEQ ID NO: 70 - DNA, 20 bp, Artificial Sequence
  Synthetic
gttaattaacgaattaaatg

SEQ ID NO: 71 - DNA, 20 bp, Artificial Sequence
  Synthetic
gtgtgtgggagacgtatgaa

SEQ ID NO: 72 - DNA, 20 bp, Artificial Sequence
  Synthetic
aaacgaagcagatgcatcat

SEQ ID NO: 73 - DNA, 20 bp, Artificial Sequence
  Synthetic
atgaaaaaatatttattggg

SEQ ID NO: 74 - DNA, 20 bp, Artificial Sequence
  Synthetic
ttttaaagcgtttttaattt

SEQ ID NO: 75 - DNA, 20 bp, Artificial Sequence
  Synthetic
atgagattattaataggatt

SEQ ID NO: 76 - DNA, 20 bp, Artificial Sequence
  Synthetic
ttttaaagcgtttttaagct

SEQ ID NO: 77 - DNA, 20 bp, Artificial Sequence
  Synthetic
atgacggctttacttgaacg

SEQ ID NO: 78 - DNA, 20 bp, Artificial Sequence
  Synthetic
cttttgtctcttttttatcc

SEQ ID NO: 79 - DNA, 20 bp, Artificial Sequence
  Synthetic
atgaaaattggaaagctaaa

SEQ ID NO: 80 - DNA, 20 bp, Artificial Sequence
  Synthetic
tttcttttttttgcttttat

SEQ ID NO: 81 - DNA, 20 bp, Artificial Sequence
  Synthetic
atgataataaaaaaaagagg

SEQ ID NO: 82 - DNA, 20 bp, Artificial Sequence
  Synthetic
ttcttctataggttttattt

SEQ ID NO: 83 - DNA, 20 bp, Artificial Sequence
  Synthetic
ttgatgcaaaggataagtat

SEQ ID NO: 84 - DNA, 20 bp, Artificial Sequence
  Synthetic
aacatttccataatttttca

SEQ ID NO: 85 - DNA, 20 bp, Artificial Sequence
  Synthetic
atgagcgattcaattgattt

SEQ ID NO: 86 - DNA, 20 bp, Artificial Sequence
  Synthetic
aattgaatcttttatttgct

SEQ ID NO: 87 - DNA, 20 bp, Artificial Sequence
  Synthetic
atgagatacaagttaaaaat

SEQ ID NO: 88 - DNA, 20 bp, Artificial Sequence
  Synthetic
ttcattgctaccttcttgca

SEQ ID NO: 89 - DNA, 20 bp, Artificial Sequence
  Synthetic
ttgaacggcaagcttagaaa

SEQ ID NO: 90 - DNA, 20 bp, Artificial Sequence
  Synthetic
ttgataatttttttctacca

SEQ ID NO: 91 - DNA, 20 bp, Artificial Sequence
  Synthetic
ttgaaggataacattttgaa

SEQ ID NO: 92 - DNA, 20 bp, Artificial Sequence
  Synthetic
ctgaattggagcaagaatat

SEQ ID NO: 93 - DNA, 20 bp, Artificial Sequence
  Synthetic
ttgaaaatcaaaccattaat

SEQ ID NO: 94 - DNA, 20 bp, Artificial Sequence
  Synthetic
cattatactaatgtatgctt

SEQ ID NO: 95 - DNA, 20 bp, Artificial Sequence
  Synthetic
atgaaataccttaaaaacat

SEQ ID NO: 96 - DNA, 20 bp, Artificial Sequence
  Synthetic
aaatttatgcctacttgatt

SEQ ID NO: 97 - DNA, 20 bp, Artificial Sequence
  Synthetic
atgatattatatcaaaatca

SEQ ID NO: 98 - DNA, 20 bp, Artificial Sequence
  Synthetic
acttttataatctttatttt

SEQ ID NO: 99 - DNA, 20 bp, Artificial Sequence
  Synthetic
atgaaaatattgataaaaaa

SEQ ID NO: 100 - DNA, 20 bp, Artificial Sequence
  Synthetic
tttaattggttttatttcag

SEQ ID NO: 101 - DNA, 20 bp, Artificial Sequence
  Synthetic
atgaaaaagaatacattaag

SEQ ID NO: 102 - DNA, 20 bp, Artificial Sequence
  Synthetic
aggtttttttggactttctg

SEQ ID NO: 103 - DNA, 20 bp, Artificial Sequence
  Synthetic
atggaaaaaaaacgtgttgt

SEQ ID NO: 104 - DNA, 20 bp, Artificial Sequence
  Synthetic
gatttttagttcttcatatt

SEQ ID NO: 105 - DNA, 20 bp, Artificial Sequence
  Synthetic
atgagaaaaataagcctatt

SEQ ID NO: 106 - DNA, 20 bp, Artificial Sequence
  Synthetic
atctttaggcaagtctgcca

SEQ ID NO: 107 - DNA, 20 bp, Artificial Sequence
  Synthetic
atgcaaaaaataaacatagc

SEQ ID NO: 108 - DNA, 20 bp, Artificial Sequence
  Synthetic
atcttcttcaagatatttta

SEQ ID NO: 109 - DNA, 20 bp, Artificial Sequence
  Synthetic
atgcaaaaagacatatatat

SEQ ID NO: 110 - DNA, 20 bp, Artificial Sequence
  Synthetic
ttcatcaataaaaagtttta

SEQ ID NO: 111 - DNA, 20 bp, Artificial Sequence
  Synthetic
ttgagtatggaacaactaat

SEQ ID NO: 112 - DNA, 20 bp, Artificial Sequence
  Synthetic
cttgaaatagttgccaatta

SEQ ID NO: 113 - DNA, 20 bp, Artificial Sequence
  Synthetic
atggcagatttcgattttac

SEQ ID NO: 114 - DNA, 20 bp, Artificial Sequence
  Synthetic
tgcaaattttctgttaccat

SEQ ID NO: 115 - DNA, 20 bp, Artificial Sequence
  Synthetic
atgaaatcatcagtagtgac

SEQ ID NO: 116 - DNA, 20 bp, Artificial Sequence
  Synthetic
tttgaaataattgctaatta

SEQ ID NO: 117 - DNA, 20 bp, Artificial Sequence
  Synthetic
atgaaaaaaagttttttatc

SEQ ID NO: 118 - DNA, 20 bp, Artificial Sequence
  Synthetic
taataaagtttgcttaatag

SEQ ID NO: 119 - DNA, 20 bp, Artificial Sequence
  Synthetic
atgaaagcagttttggcaac

SEQ ID NO: 120 - DNA, 20 bp, Artificial Sequence
  Synthetic
tttaaaaaatttagcaatta

SEQ ID NO: 121 - DNA, 20 bp, Artificial Sequence
  Synthetic
atgaggattttggttggcgt

SEQ ID NO: 122 - DNA, 20 bp, Artificial Sequence
  Synthetic
tgtaggtaaaataggaactg

SEQ ID NO: 123 - DNA, 20 bp, Artificial Sequence
  Synthetic
atgttaagggcattgttaat

SEQ ID NO: 124 - DNA, 20 bp, Artificial Sequence
  Synthetic
gtagtagaaagaattgccct

SEQ ID NO: 125 - DNA, 20 bp, Artificial Sequence
  Synthetic
atgagtaaactaatattggc

SEQ ID NO: 126 - DNA, 20 bp, Artificial Sequence
  Synthetic
attattaaagcacaaatgta

SEQ ID NO: 127 - DNA, 20 bp, Artificial Sequence
  Synthetic
atgagtaaactaatattggc

SEQ ID NO: 128 - DNA, 20 bp, Artificial Sequence
  Synthetic
gcttaaagttgtcaatgttt

SEQ ID NO: 129 - DNA, 20 bp, Artificial Sequence
  Synthetic
ttgcttttaggaggtcaatc

SEQ ID NO: 130 - DNA, 20 bp, Artificial Sequence
  Synthetic
atccaaataataagaaacgg

SEQ ID NO: 131 - DNA, 20 bp, Artificial Sequence
  Synthetic
ttgaaaaaatatattatcaa

SEQ ID NO: 132 - DNA, 20 bp, Artificial Sequence
  Synthetic
attgttaggtttttcttttc

SEQ ID NO: 133 - DNA, 20 bp, Artificial Sequence
  Synthetic
atgaaagccgttatacctag

SEQ ID NO: 134 - DNA, 20 bp, Artificial Sequence
  Synthetic
ctcaaatttcaatccctttg

SEQ ID NO: 135 - DNA, 20 bp, Artificial Sequence
  Synthetic
atgaaaaaagttaaaagtaa

SEQ ID NO: 136 - DNA, 20 bp, Artificial Sequence
  Synthetic
gtaccaaacgccattcttgt

SEQ ID NO: 137 - DNA, 20 bp, Artificial Sequence
  Synthetic
atgaaaaagaacatatatat

SEQ ID NO: 138 - DNA, 20 bp, Artificial Sequence
  Synthetic
ttcatcagtaaaaagtttta

SEQ ID NO: 139 - DNA, 20 bp, Artificial Sequence
  Synthetic
atgaggattttggttggcgt

SEQ ID NO: 140 - DNA, 20 bp, Artificial Sequence
  Synthetic
tgtaggtaaaatagaaactg

SEQ ID NO: 141 - DNA, 20 bp, Artificial Sequence
  Synthetic
atgagtgatataacaaaaat

SEQ ID NO: 142 - DNA, 20 bp, Artificial Sequence
  Synthetic
cccttttattgctctattcc

SEQ ID NO: 143 - DNA, 20 bp, Artificial Sequence
  Synthetic
gtgtataatatgactataag

SEQ ID NO: 144 - DNA, 20 bp, Artificial Sequence
  Synthetic
tttggaaataaaagcaaata

SEQ ID NO: 145 - DNA, 20 bp, Artificial Sequence
  Synthetic
atggagaaatttatgaataa

SEQ ID NO: 146 - DNA, 20 bp, Artificial Sequence
  Synthetic
ttttaaatttcttttaagct

SEQ ID NO: 147 - DNA, 20 bp, Artificial Sequence
  Synthetic
atgaataaaaaaacaattat

SEQ ID NO: 148 - DNA, 20 bp, Artificial Sequence
  Synthetic
atcttcttcatcataattat

SEQ ID NO: 149 - DNA, 20 bp, Artificial Sequence
  Synthetic
atgagaaataaaaacatatt

SEQ ID NO: 150 - DNA, 20 bp, Artificial Sequence
  Synthetic
attagtgccctcttcgagga

SEQ ID NO: 151 - DNA, 20 bp, Artificial Sequence
  Synthetic
atgaacaatttagcatacaa

SEQ ID NO: 152 - DNA, 20 bp, Artificial Sequence
  Synthetic
atttaaaaaatacttattga

SEQ ID NO: 153 - DNA, 20 bp, Artificial Sequence
  Synthetic
atgcttattaataaaataaa

SEQ ID NO: 154 - DNA, 20 bp, Artificial Sequence
  Synthetic
ctttagtctaaatatgcgct

SEQ ID NO: 155 - DNA, 20 bp, Artificial Sequence
  Synthetic
ttgccgcaagatacaattag

SEQ ID NO: 156 - DNA, 20 bp, Artificial Sequence
  Synthetic
aactatatcttgagtagtaa

SEQ ID NO: 157 - DNA, 20 bp, Artificial Sequence
  Synthetic
gtgtataatatgaccataag

SEQ ID NO: 158 - DNA, 20 bp, Artificial Sequence
  Synthetic
tttagaaatgaaagcaaata

SEQ ID NO: 159 - DNA, 20 bp, Artificial Sequence
  Synthetic
atgaaaattatcaacatatt

SEQ ID NO: 160 - DNA, 20 bp, Artificial Sequence
  Synthetic
ttgctgagcttggcaggtac

SEQ ID NO: 161 - DNA, 20 bp, Artificial Sequence
  Synthetic
atgagaaatttggtgcacag

SEQ ID NO: 162 - DNA, 20 bp, Artificial Sequence
  Synthetic
atttaaaaaatgcttattga

SEQ ID NO: 163 - DNA, 20 bp, Artificial Sequence
  Synthetic
atgaataagaaaatgaaaat

SEQ ID NO: 164 - DNA, 20 bp, Artificial Sequence
  Synthetic
ttttaaattttttttaagca

SEQ ID NO: 165 - DNA, 20 bp, Artificial Sequence
  Synthetic
atgaataaaaaaacattgat

SEQ ID NO: 166 - DNA, 20 bp, Artificial Sequence
  Synthetic
ctgactgtcactgatgtatc

SEQ ID NO: 167 - DNA, 20 bp, Artificial Sequence
  Synthetic
atgactaatttagcgtacag

SEQ ID NO: 168 - DNA, 20 bp, Artificial Sequence
  Synthetic
attaaagaaatacttattaa

SEQ ID NO: 169 - DNA, 20 bp, Artificial Sequence
  Synthetic
atgaataagaaaatgaaaat

SEQ ID NO: 170 - DNA, 20 bp, Artificial Sequence
  Synthetic
ttcttttttatcttcttcta

SEQ ID NO: 171 - DNA, 20 bp, Artificial Sequence
  Synthetic
atgaataaaaaaatattgat

SEQ ID NO: 172 - DNA, 20 bp, Artificial Sequence
  Synthetic
atatgaattactatcctcaa

SEQ ID NO: 173 - DNA, 20 bp, Artificial Sequence
  Synthetic
atgactaatttagcgtacaa

SEQ ID NO: 174 - DNA, 20 bp, Artificial Sequence
  Synthetic
tttgatatattgtaaatatc

SEQ ID NO: 175 - DNA, 20 bp, Artificial Sequence
  Synthetic
atgaataaaaaaacaattat

SEQ ID NO: 176 - DNA, 20 bp, Artificial Sequence
  Synthetic
atcttcttcatcataattat

SEQ ID NO: 177 - DNA, 20 bp, Artificial Sequence
  Synthetic
atgaggattttggttggcgt

SEQ ID NO: 178 - DNA, 20 bp, Artificial Sequence
  Synthetic
taaaatttttccattaattg

SEQ ID NO: 179 - DNA, 20 bp, Artificial Sequence
  Synthetic
atgaaaaagaacatatgtat

SEQ ID NO: 180 - DNA, 20 bp, Artificial Sequence
  Synthetic
ttcatcagtaaaaagtttta

SEQ ID NO: 181 - DNA, 20 bp, Artificial Sequence
  Synthetic
ttgggaggatttaatatgga

SEQ ID NO: 182 - DNA, 20 bp, Artificial Sequence
  Synthetic
actttgtttgatatgtactt

SEQ ID NO: 183 - DNA, 20 bp, Artificial Sequence
  Synthetic
gtgcttaaaaggggggctaa

SEQ ID NO: 184 - DNA, 20 bp, Artificial Sequence
  Synthetic
agtgttgtttggtttagttt

SEQ ID NO: 185 - DNA, 20 bp, Artificial Sequence
  Synthetic
atgaccataagggaaaattt

SEQ ID NO: 186 - DNA, 20 bp, Artificial Sequence
  Synthetic
tttagaaatgaaagcaaata

SEQ ID NO: 187 - DNA, 20 bp, Artificial Sequence
  Synthetic
atgaaaatcatcaacatatt

SEQ ID NO: 188 - DNA, 20 bp, Artificial Sequence
  Synthetic
gttttgccaattagctgtaa

SEQ ID NO: 189 - DNA, 20 bp, Artificial Sequence
  Synthetic
atggataataaaaaacctaa

SEQ ID NO: 190 - DNA, 20 bp, Artificial Sequence
  Synthetic
tttaacatattcatcatata

SEQ ID NO: 191 - DNA, 20 bp, Artificial Sequence
  Synthetic
atgaatagtttgacttacag

SEQ ID NO: 192 - DNA, 20 bp, Artificial Sequence
  Synthetic
tttgccaccttgtaaatatt

SEQ ID NO: 193 - DNA, 20 bp, Artificial Sequence
  Synthetic
atgcaattttatgatttaag

SEQ ID NO: 194 - DNA, 20 bp, Artificial Sequence
  Synthetic
agtgttgtttggtttagatt

SEQ ID NO: 195 - DNA, 20 bp, Artificial Sequence
  Synthetic
atgagtaatttagcctacaa

SEQ ID NO: 196 - DNA, 20 bp, Artificial Sequence
  Synthetic
attgaaaaaacacttattaa

SEQ ID NO: 197 - DNA, 20 bp, Artificial Sequence
  Synthetic
atgaataaaaaaataaaaat

SEQ ID NO: 198 - DNA, 20 bp, Artificial Sequence
  Synthetic
ttcttttttaccttctacag

SEQ ID NO: 199 - DNA, 20 bp, Artificial Sequence
  Synthetic
atgaaaatcatcaacatatt

SEQ ID NO: 200 - DNA, 20 bp, Artificial Sequence
  Synthetic
gccaccattattgcagttac

SEQ ID NO: 201 - DNA, 20 bp, Artificial Sequence
  Synthetic
atgaataagaaaatgaaaaa

SEQ ID NO: 202 - DNA, 20 bp, Artificial Sequence
  Synthetic
ttttttatcttctatatttt

SEQ ID NO: 203 - DNA, 910724 bp, Borrelia burgdorferi
  misc_feature (804071)..(804071): n is a, c, g, or t
  misc_feature (804561)..(804561): n is a, c, g, or t
taaatataatttaatagtataaaaaaaattaaatcaaattaataatagtttaaaaaactgtttgtataatataatattattatatataatattaagcaactactatgatactaatgaagtatagtgctattttattaatatgtagcgttaatttattttgttttcaaaataaattaactacttctcgatgggaattccctaaagaagatttaattaaaaaaaaaataaaaataggcataatttaccataattacataaattctatcttttacaatgaaaattataaatacattgcctttatcggaatattgacatcttataatgaatggattgaaatacaatttagccccataaatttttttactatcccaacaaataaagattttatttcaaatacttatttcaatttagctttcactatttacattaccaagtattcaattttaactgatacacttgctataaaattttttattggaacccaaatcgatttaactctgagaactactatatttacaggaaaaacaactcatgcatttctctatccaattcttcccataattaccttcaaatttgaaattgatttcatacctaataactatagtatttactataaattatcgacttcttttaaagaatttatccttttagatctaggaatttctatatttatataatcctttttttattatagaactttttttatggtataaattatttaacacaaattgtaaaaagaccaaaaacaaattttcaaaacaatttcactaaggaatgagtactatattgacacccgaactcaaagactttttaatagcattttcaatattagaaaaacttcttgtaattgctcccatatcataagaatctgtcatcataatactagtaatatttaaattttcccttataatattaacaatacttttagacatgctagttatatctttagaaattttaggaacatttacatgaccaatcataataaatttagcagctctaccaaaaacaaatggaacaaaattatttaacattaaaaagcttttactataaggcaaaaatgctaaatatttatgtgtatctgtagttgttccccctaatccaggaaaatgtttgattgccgaaaatactccattattctgcataccatcaataaaagcttctaccataagtccaatattataagcggaatatcctccaaatgtcctatttaataaaggagtatgtggtgcaaattttatatcggcaactggagccatatttaaattaatacccaatctacgcaattgtttagcaagaacttcaccaattttataaataagatgcaaatctttaacaccccccacatgctccatggccggaaaattataaacccccatttttttattttcactagctctactaactattcccccctcttcatcaatagcaataaaaatatcatgtccaatatgactctttattgcattaatcaatccctttgtctgctccgcatcttttaaattttctctaaataaaattataccaattggattaatcttttttattctattaatatcatcgatattaagctcttgaacattcttaaaatttgttaaatttctaatcccaataaataaatttctatcttttaaaatagtttgaaaatctaattcacctaagaattttatcaaatctacaagatctgatttatccttgttaaaatattcataatctatttctggtaaagattctatcgcaattaaatttaagcaaaaaaagctaaaaaacaaaaaagaaaaggtttttaaaaagtccatttatatagcccacaaagcaaaccataatcttttgataacaaatcaggaagagcgctaaaattcttagcagaattatcgatcccctttttacaacaatatccacatatatcttcaagattactattaagcaacatgttaataaataactttgcaggaaggaatcttctatttctatcaaccgttaaaattaatggattttctattaattttaacacttcccacgttatttgctcaaccgaaatatatttaccaatttctttatcttgctctataattctaatgggcattttttctattatttcatcaatattttttatcaaatactctaaattaaaaagtccagttgcacaattaaacagcagtctattacccttattttcaaactcttgcacaatctctgaagaaatccccccgccaatatcaacacaagttaaacgattttcaccatttactgccaatatccctcccttaaaatccgctttgcttttaaaactaaattcaaacccagaagaacaattagtcaaagccattaaagcaagtgctttaaaattaattgtaaagcccatattatcaacattaccaatatatataaatcttttaccagattcataaagctttaaataaatatcttttaaaattttaaaattttgaccatgaccggcaggcaaagccaaaatagaattagcatttttattatctttgagagtaaaatattgataattggagctattcagtttttcataacaataaactaaaggttgaacagctgtgaaaacatcttcttttttgagattgcaaaaatttacacttttaatcaagtcatctgcaaataaatcgtccaaagattttgaaataaattcatccgttttgcaactagtcatttgaaatattgagggcttgatcattttgccacaaaaagattcatatcttttagcaaccattaaaagatgcctaattttcaaagccaaaaatgaaaatccaaaactaccatctttgttaatataagctggtgttatcccctttggaaattctccaaatttttctttaaattcaagtattttagattcatataacatatataaatcttcatttaacgccctatttttagctaaatcaaaataacttgttgcagagccaccatttaagattccaaaagaaaggtatgggaaaagcattagacccaaattttcaagatcacaagaagaaaaaatataacaatcaccttcttctgattgcaaaaatttagaaaaatcatgaaaatatttttttaaattatcttcaaccaagcctttgttgaacttaaacctcaaaatttcatccgaaatattaaaaatattttcatggtatcgcaaggaaaatatttaatggattcaaaagtattaggacaaatcttgccagaattaagtttttcaagtatcatttcagaaaaaattttatcaactttaacattcataagttaaaaccaaaacccttaaagaaaagcttattaatataagcaaaaaaacaaatttttaagtataataacataagtggctatactattgattattaaaattatagcaataatatgactagaatatcaatgagaagaaatttacatgcttaaacaatattcacttaacatgaaaaattttaaaaaagcttttgatgagatgatattttctccttcaggatttagaaaaatttttgcaaaatcaaaaaatgaagattcaacagaaaatgaaataaacaataaagataaagcactaatagcactaataatcttcacaatatcaaattattttaaaaatgaatctaagccctatattggattgggattagattcaagaccaactggcaacattattgcagaaataacaataaaaatattaataacaaacaaagaaaagattagattttttggaatacttccaataactgaaattttagcttatacaaaaaacagcaaagattcaaagggctttatttatatttccgcaagccataatccaataggatacaatgggataaaaatagggttaaacgatggtggcgtactaaattccgcaaaagctaatgaaataatacagcaaattaaaaaaaatagccaaaatgaaaagctaataagccatttaattaacactctaaacaaatttgatgaagataaatccaatttagaatattataataaaataataaaattagaaagaaaaaataaaaaccaatcttatgaagcatataaatcattaatacatgaaatagcatatgaaaacgatattaacaataaaaatatcgaaattttaaagaaaagaatactaaaaaatccaattggaataatagcagagatgaacggaagctcccgaatcaattcgatagataaagaattgatagaatctttgggattgaaagtaaaattatataatgacgaaataggtatttttaagcacagtattattcctgaaggaaaatccttaaatgaatgtaaaaagttgctacaaaataaatatatacaagacaattcttttgagctaggatacgtaccagattgtgatggagataggggcaatctggtgtttatagataaagccacaaacactgcaaatatcatcgaagcacaaaaaatatttgcacttgtagtcatttcagaacttagctatctttattatacaggaataaaaaataacatagcaatagtaaccaatgatgcaacatctctaaatattgaaaaaattgcaaattttttcaacgccaaagtttatagagtagaggttggagaagctaatttaacagagatggcagatgatttaagagcccagggattgattgtaaaaatctcaggagagggatcaaatgggggatgcataattcatccttcaagggtaagagacccaattactactttacttagtatcgtaaaattattaaaaatgaaagaactttaccaaatatggtgtaaattgtctaaaaaccactataaagaaaagtacgacttaaaagatattttaaatacaacaaatttttatagtaatgtaatagtatcatccaaaaaagccaatttaacaaatctaaaaatagaaaatcaagaaattttaaaaagcaattatgaaaatctattgattaaagagataaaaagtaataagttatttcaagaattatcagtagttgattatgaaatcattaactatgaaggcaaaagacaatctaagattagaacaggagattcttcgggaggattaaaggtattgttaaaaactaataaagaaattgttgcaaccttatggatgagaatctcaaagacagaaccagtaacaagagtgctcagcgaagttatttacacaaaaagaaacattttattcaagctactagaatttaacaaaaaattaataaaaaaggcaaatctacctaataattaatattgtttgatttaaataataagttaattactaatataagtctagcataaaatcaataattttcattcttcattttttaattttttctcagcgctatattttattccattccaagtttttgaaagccctattaaatccttaacatcttttactactttatttgcaataaacctcgccttgcttgtaccatcaaaaataatttcatcaatgtaatctttttttttggcttcataaaaacttcttttatctcttattggctttaaaaaactattcaaagctaaaaacaattttttcttaacctcaacatcacctactttacccttcttatacctacttttaagatcctcaacttcttcatgattactattaaaaaaactgtgataaataaaaatgggattaccttcaacattgccaggaatatctgcccttatcctatttggatctgtatacatagacataatttttttttctaataaattttcatcgtcgtttaaaaaaattgcattatcaaggctcttgctcattttatttttgccataaatacccaccaaaggacgagaatctgtgaaaacagattcgggtattgggaaaaaattatttttgtacaaatggttaaaccttcgtgcaagctctcttgcaaattcaatatgagattcattatcacgcccaacgggaactaaatttgcttttgtcattaaaatatctgcactcataagaacaggataccccaaaaggccataaggaatctctttaagtccagctgcaatgctcatgtcttttatacttggaatcctttgcaagcgcgcaacagtaacaatcattgaaaatattaaatgaagctcaaaaagctcgggtatggctgattgcagatatatactaaccttatcaggattaattccacaagcaagataatctaaaaccatttctctaacattagaaggtattgtattgatgctcttcaagtcaggctttgtagtcaaagtatgtaaatcggctataataaaatatgtttcatactcttcttgaaattttaaccgatttactacagaccccacatagtgccccaaatgaagagcgccagtaggcctatctcccgtaagcataacctttcttttcaaaatcaaatctccttatctttacttgaaatatggctaatattacttaaaatctcagagccacccaaaaatacagaaaaagacttaagccaactcacattatcaactattacctttacaatcacagtgaaaggataagatattaaaagacctacgataccccaaagccatccccaaaaaaacaaaaaacataaaagtaaaaatggtgaaatatcaagtcttttcccctgcatttttggctcaagaatatttccaatcaacatttgaatagaagtattatatataaaaacataaagcactatgtttaaatttggataaaattgaattaaagatgttattacaataaaaaacacagctaatatggatccaatgctgggaataaaattgaaaacaaaggaaagaactgcccaaacaagaggaaaatcttgcccaaacaaagttaatccaataaacactaaaatgcccgttaagcaactaacaagaatttttattcccaaatatttgccaatttgattattaatggtatctaaagccccaataaatctagtagatatcggctttttaaaagctttatcaagcttcatttcaaaaacatgtatttctgaaagcaaaaaatacaacagcaaaaaaactactaccaaactgcttgtaaatccaataatttcattataagctcttgttaaaaaaggataaatgtaaccagaaaaattcacatcattaataacagaactatcaactttatatcgactaagcacatctttcatgataaatgctaattggttttgatagtatggcaattgcttcattaaaacagtaacgctgtaataaacaaaactaaaaatcaaataagaaaaagaaaataataaaaaaaatataataaaaactattaaaaattttgggactttgaatcttgctaaaaaagtataaacaggataaactaaaaatcccaacactatggaaatagccaaaggtttaaatacggcttctgctattttaaaggccccaataaatattaaaactataacaatacaataaaaaacagattccactctccaaggctttaacccttgatttgtatttaaatctttaagcatattcccctcttttcgtttttttactgcttttatcaactaaacaaaagtaagttacatgaatcatacgctcaagcaaattttctccattatccaattatacaatttagtacccttagtataattggcctcagcaaaatctccaactctattctcataaaacaatttttttgcattcttatcatttccatgatacactgtcaaagtatttctacaatgtttcaaaatattattcaagatttcaaatgccggaacatcgctaaatccatctgcaatgtaaaatatatttttaaaaggaatttgtcttttgctctttggcactctctcattaatcttctcataagaccctttattgatttcaaaaataactctggtttttattgtatgatctacaaagtagcaaacactgcttaaaatcttatttttagaaaatttatcatctctgagttcgtaaaaaggcattaaataagaatctataaactcacatgcccacactttactcacataaggggcaattttacttcccaaaatcatttgtctaaacccacttgaaacaatgtaaattttaatctgagacttgctattttccaacttcttatttatttcagatatctcatcaaataagccaataaccccttcaaaaaatcttaacttagcacccaaattaaataatgctctattatccagactttcaaaaaacccttcccttacgtaggttaaaaaatgggataaatatatcatttcattagaaattatattataaccgttttgcttataaacatactctaaaccttcaacttctctccaaaaagaacaagaatcaacacaatactcatcaaacagtacttgctgcatattgccataaataagagtattatcaaaatcaaatattaaagctataatattttctctttcattcataaattcaaaaacaatttaatttaataattacaaactgtgcttatttatatattttatattatactaatataggttaataagtacagtgttttcacattgagtagaaaatttatgatagacataaatgatttaaatcaaataaaagatactttttcaagaatcttagatctaagcttaattagcatcctagtatactacatatataaaaacgtaatcaattcttattctacaaatctattaaaaggaatgttgatcattatctctgtaggaattatctcatattatttaaatctctatactattagttggctgttaaattatatagccaatatattaccaatagcaatagtcatactttttaatcaagaaataaaaaaaataataatgcaaattggaaatttcaatttggcctttaagctttcaaataaaaaagaagaaactttaaaagttatttctgaaatcctaaaagcagtcaaacacctatctgaaaacaaatccggcagcttgatatgcattgaaaaaaaaatacagttggagcaaataataaacaaaggaactaaaattgatgcgctaatatctagtgaactgctaatatcactatttgagcgcgaaactcctcttcacgatggagctgtaataattagcaagaataaattaaaatacgcaggctcatttttaccattatctaatgttgattctattagcaaagcatttggaacaagacatagagcaggacttgggatttctgaaaattctgatgcaataacaataataacctccgaagagactggatctatttctattacaatcaatgcaaaattggaatacaatttaagcttaagtgaaattagaaataagttaaatctagagctaatagagtaaaataatggaaataggcaaaaaaataataaatataataaagttgctatttgatgattggcaaaacaaagctatttccattttaatagctattttaatgtttgtagcatttaactttaataaaatagaatcaataacaactgaaaaagaattcaaaattatcttgaatgatcaaatagctcttggaaaaataccagactttagcaaaatcaagattacaataaaagtcaacaaagatgacttaaaataccttgatcttaataaaataatattatttattgaagcatcaagcataaagattcctggaagctataagctaccaataaaaataaaaaatcttaattcaatacacattgcagaatataagctttcaaaaacaaatgtgttgctaaatcttgataacaaagtctctaaattagttaaaatagaacccaagtttaaacttatagaaaaagatggcaagggagaatattttattgcaaaatacaatatattacctgagaatttattagtatatggacctgagcaagagctcaaaaaaataaacaccattcaaaccaacgtaaaagagtttgacacaagaactctatttgtatcagattatcttgaagtagttccaccaaatcctctagttatgtttgaaaaaagtcacgtggtagtcaatatttatttaaacaaaaaatattcaaacacaacaataaaatctcctaatcttatttttaataatcttaaaaatggccttgaaattaaagataaagaaaaaataataaactcagaaaataaaatgttcgtaaaaataaaaacaagactttctgaaaaacaaattaaagctcatataaacaatcaaaatataagccttgcttttgatttagcagatataaaaactcccgggatttataacattgctgcaaatataattcttaaagagaatatcaatgaaacagaaatatatgattatgaacccaaaaaaataaaactagaaataattgaaagctcagagatcaaaccatgaagtcaataggatgtgatataataaaagtagaaagatttaaaaattttttagaaaataagaaaaaaatggagaggttctttacacataaagaaattgaaaattttaaattaaaagggggtagcattatagaaagtttagctggaaaatttgcagctaaagaatctttaattaaagcattaagtccactgttgcaatataaaataaattatacccttaaagatattgaggtaataaaatctttaaaaggaaatgcggagttttgtttgcataatgaagttgaaaaatttgcaataaaaatgaatttaaagctatacctaacaatatcccatgaaaaggagtacgctattgcatttgtaatagtagaaaattaattcatgaaaaaaatatcatattttacaaaagaaaaaattgagtgtcctgtatgctcttttaaatttcaaaaagaagaatttttgaccggaagtagtagattaatagccggagagttaaaaattgatctaaaaagagaatatataaaaaacgacaaatatggcaacatttatcctagaatatattctataacagtatgtccaaaatgctactttgcagcattcccaagcgaatttaattcaatccctaaaaacaagaaagaaattttgcaaaacaaaaaatacgaaagaaaaaaaataaatacaatttttgacaacatgctcaacttcagtaaacctaggacattaaaagaaggagctgcaagctatattcttgccatgctgtcttatgagcatctggaaaagaattataaccccacattaaatcaagcaaagtcagcaataagagccgcttggacattcgaagaccttgaaaaagaagaaccaaacaaaaactataattatcttcaaaaaatattttaccacaaagctgcatacctttataaactagttattgaaaaagataaagacaattcagaacctgttagtgcatcaaccatgtttggcccagatacagacaaaaattatggctatgatagtgtgctatacttatcaggccttctagaatacttttatggaaataaagacaataaagaatatagatataaacaattaaacgacataaaaaccactctttctaaaatagcaggcatgggtaaattttcaaaagaaaagccttcaatacttttagataaaatcaaagaagtttactttaaaatatcaaaggaaatgaaaaatcttaaataaatgaaaaaaatattagctgaaatcgcttatgacggatccatataccatggatttcaaatacaaccaacaaagcctacagttcaaggagaaattgaaaaagctctaatgaagatcaataaaaaaaaagtaaaaattcattcatccggaagaacagataaaggcgttcatgcaaaaaagcaaataataacttttgatataaaaatcaatattcagctaaacaatctaaaaaaagctttaaatgcaatattattaaaaaacagcataaaaatactaaagctcaggtatgtaaaaaattcatttcatccacgttttagcgctcaaaaaagaaaatatagctattgtatattaaacagcgataactactatccctgggaaggttatcaagctcactatgtaaataaaaaactaagcataagcaatttaaaccaaatggccaaaacattgattggaaaacatgattttaccacattttcatgcataaaagataaaagcaaatctaaatttaggcatatatattttgccaaatttaaaaaaagaggaaaatatattatttttgaaataataggatcttcttttttgtggaaaatggtaagatcaataataggcacaatgctggacattgaaataaaaaacgaatcaatttctacttttgaaacaatattaaaatcaaaaaatagaaaccttgcaagaacaactgcacctgcaaatgctttatttttagaaagagtttactatgaataatagcgttttaactaaaaaactttttttacttaaaatattgacaaataatatagaaggcaaaattaccgaaaattttgaagaaatagacaatgaaattaaacaaaaaatagaaaaagctaaaaacactaaaatttatcaaaaaaacgaaaatagcaaagaacctgcaaaattacctttggaaaaccaaaattcaaaaaacatattattaaataatagcttacaagaaaaaggtatcaacgatcaaatcataatatatgtaaacaaaaactatcttaacgaaccttcaagggatattataacaaaatggtgcaaaagcataaacatatacaattataaaataatagatactattgaatcacttaacttagaaatcagcaacaaaaatcctaaagcaattttatcttgcgaagaaatagattttttcttaaatcaaccgctaagaattcacattgtaagaggaatagagctgagatttaaaggcattccattagtttttacatatcttcctacaaatcaaataaaaaatccagaattaaaaaaagaaatatggcaagatttaaaaataataaaaggcataataaaatatggttgagcattatcattcaacttattactatgaaatagcaataaatattcctttaaataaactttttttttacaaatttaacttaaacctagaaattggaataagagtaatggttaattttaatggctccaataaaattggaataattattaaaaaatattttgaaaacgaatttaaagaaaaatttgaatttaaaataaaagaaattattaaaataatagatacaactaaaataataacagaacataacattgatttagcacattggattagtaaaaaaacattttcgggatttggagaaactttattctttgggttgccccaaaattcaaaagctaaaaaaaatcaaacattaccttcaataaatgagcatccggatcataaaaaatgccttgagctaaacaacgaacaacaaaatatttacaaagaaattatcgggtcagaaaaaaccaatgttttttacctttttggaatacctggatctggaaaaactgaaatatttatcaaattgtgtgaatactatttagcactagaacaacaagtgctttttttgattcccgaaatatcattaggatatcaaataataaaaagaataaaatatgcattaaatatgcaccataaaatttatgaatataactccaaagttccaaattctgataaaaatttaatatggaataaagttaaaaatggagaaagcctggttgtcattggcatcaaaagcgttttaatgctgcccttcaccaaattgaaattaataattatggacgaagaacacgaaactacatacaaatctgaaaacattccaagatttcactcaagacatatatcattttttttacaaaaaaaatttaatgctaaatttgtaatgggaagcgcaacaccttctcttgaagcataccacgcaatgaaaaataaccaaataaaaaaaataataatgcaaaacaaattctctcaaagcaaaatagaagatataaaaataataaatatgaaaaaagaacctagcacaatttcatcagaactattatacagtatacaaaaaagtttaaatgaaaaaagacaatctttgattttcattaataaaagaggatatctaaaaaatctcgaatgcaacgaatgtgggcatataatttgttgtccaaattgctcatttggtttgatttaccataaaaaagaaaacaaacttttatgccactattgtagttataaaacaaaaacagcaagccattgccctcaatgcgaatcaaaagatattaaatacaaaacttatggaattcagcttgttgaaaaagaactaaaaaaatttttaccaaatgcaaaaattgcaagaatagattctgatattacaaaaatagaaaatatagattcaataaataagttcgaaaataaagaaatagacatacttatcgggacacaaatcattgcaaaaggatttaattttgaaaatataaaaacactgggtataatcaacgctgacattggaatgggactgcctgattttagaagtggtgaaagaatttttacaacactctcacaaattatgggaagagccgcacgattcaaggatgacaacataattattatacaaacaaaaaatcccaattattatgccataaaatatgcttataagaatcaatatgaacaattttacgaagaagaactagatatacgaaaaaaattgaactatcctccgtttaacaaaattattagaataatatttagaagcaaaaatgaagaatctgctaaacaaaaatgttgggaattttttgaaaaatctaaagaatttttgcaagaagaaattgaacacttaggcccatcagaagctattatgaagaaaatatctaaaaattacagatacaatataatatacttgtcaaaatcctacagcctgcttgaaaaactagttaacaagacaaaagaaaaggtaaaaatgacaagcactgtttatattgagatagattattacccaatatcattaatttaggtaaaatctaacccttctttacttaaagacttaagaaacgttgaaagcacataaagcgctttatcattatgacctccctcgggaataataagatcagcatattctttggtaggctcaataaatctataataaccccatctagtggtatttaaatactgatcaatcaccgattctacagtacgtcctcttttggaaatatctcttcttaaacgcctaataaatctaatatcatttggggtgtcaatatatattttaagatctattaaatttcttactctctcttcaacaaaaatcataataccctcaacaataacaacaggagttggaacaaccaaaaccgttttaagttgtcttttatgattaataaaatcgtaaaggggcatatctattggactatttttttttaaattttttaaatgttcataaaacaaattattatcaaaagcatccggatgatcaaaatttaccttagaaaattcatgttcataatcgcctacactcttatagtaattatcttgagaaataaggacaaattctggaataaactcactaatcttgcttacaactgtagtttttccgcttccagaaccaccagatatcccaataatcttagccatcaaccaacttctttttttgcttgtggcatgtctttcaaggttccagcaacaaacacattcttaaatcccatgctttttaaaacttttttagcctcgtaagacttattaaaacttttaccataaacaattattggggactcaaaatcacctaatttatcctttttagcaaataaattattaaaaggaatgttaattgacttcaaataatgagacttgctatattctttgggagaccgaatatccaaaatttttgctccattttggattttttctaacaaaaacagattagttcttttcatcctaaggataataaaaaaccaaatataaaaaaaaagcagaactattaatactgcaaatcttgcataattcatcgccatagtttcatgaacatgatatcaaaaaaaataaaaaaagtgaataaaattgttttttttgcaaaattaatatagaattcaagtaaattactagcttgtagcttaaaagtggctctaacattaagatgaaaaagaaaaaaaagatacgttgtcgtagaattaaaaaaaaactcaaactattattactaatactaataaaaaaattaaagactataactaaaaatcctaaattaatatttgatagcacaatacaaataactttaggatctgcgctaatggcaatttccaccaatgttttgtatattcctcatggacttcttagtgggggaattgggggcatttcattaatgctacattacctattaagcttcaatttgggatggacaatatttgcattaaacataccattatttcttattggaataaaatttttaaacctaacatttataattcaaagttggatttcaatgggattatattctattatcataaaccactcccagtttttacaaaataaaatacatcttaatgatatgatgcttgtatcaatactagctggacttatttctggacttgggcttgggctaatatttaagggcaaaggatcttcagggggatcagatataattgctatgatcattaaagaaaaatattcaattagcattggaacaacaaacttcgtagttaatcttgtggtattaatacttgcaacctttttctttaatattgaaatcgctctttatacactaatagcatcatttgtaacatctatcatgacagataaaacaagtactggatttggcaatcaaaaagcaatattaatcatttcggataaaggaaaagaaattgcttatcttcttacaaacaagttaaaattagccgctacattaatagacggaaaaggtgcttgggcaggaacagaaaaaactatagtatttatagtagttccaataatgcgtttatcaagaattaaatatatatcacaaaaagttgatccaaattgtttcattaccgttattaacactaatgaaatcactgggggtaaaataataactgacccaatctcattaaaacaagaaatttaaaattaaaaatctcttaaaaaaagaaccaaattatcaataatcaaatttaattcatcactcttgtaaaaatttgacaaaaaaataacaaatcttttgggaaattcagaaataaatttcttaaaagaattttttccaacatcaatttcaagcttataagaatgaagcattagcgttattttttttaaactgccatctactctgccataaacctcatctcccaatattggaaaattaagatatttcatatgaactctcaattgatgagtacggccggttttaggctttaaagctaaaagagaatattccccaaaattgagcagtaatctatattctgttaatgccttttttcctctatctttagaaacactaaattttttcctattgtgtttatctctatctataaaagattcaatgcttccaaaaaaactattaaaattacccttaacaattgcaatgtaaactttatttgttcttttatctttaaactgctgagctaaaaatcttaaggtgctaatgttttttgcacaaattagaactccagaggtatctttatctaatctatgaacaattccgggtctaattttttcttcattaaaattaattttcaagctttttatatgatataaaagaaaattcactacagtatcatcccaatgtgatattccaggatgactcaaaattccttgtggtttattcaaaacaataacattggaatcttcataaattatagcaatagggatattactcggcctaaggcaatcaatttgactactctcctcgtcaaattcaattagtatttcatcatctttaaaaacaggcttggataattttatctttaaaaatttaccattactctttttaaacgcttctacatttcttcttttgatctgacttctggtaaaaacttcaaaattgcctgataggtaaagatccaatcttaaagcattttctttaacggtaaattctctcttaactcttatcatatcattaaagaaaataatcaagcaaggcaatggttaatgcaactattgctccaatagaagctgaaacaataaattttttataaatctcatcttttgaaaaactaggaccatttgaaaaaggatatggaacgtaatttgcattcattccgctataaaaatagtaactcacatcaaaaaaaaataagctcaaaaataaaactattggaaaagatccaatactaatagctgaaaacctaaaaaaatcttttgctgattttgactcaagatcattctcaagattcaaagccttattctcttgaatatttttataaagaaaagaatcgtcattatcagcaacagacatattattattttttttatgagaaacaaaattgccactggaagtcgatttgtcttgcaatggcaaacttttagcatcacttaactttaaataattaaaattggacttgaaataatcaagtgaatttgaataaacatttaaaacactaaaaagcaacaacaggcttacaataaacataaatttactacttaaataattctaactttaaagtctcagttatctcatcaacaatctcagaagaaccaaaatactgtacaggccctggatataaatacaaattatttaaagcccacttatcacgatttttaacaaactctttaaatggtcttccttctaaatcaactaragctttttttataacaggctttttctctccatacctctcttccatattcatcaacattgttagaggcactccccctgcaatccaatctgttggttttaaatttagattttttatacaagacatatagcctgttagcccatttaaaataagaacaacagcattataccctaagctataacaataatcactatcaaaattagaaggaaaagcgcttctgccttcatagccaaaaaaatgatcaaccggagtaaaacttcccttatattctccccttttcttcatgtcatttaatcttgattgaatcatctcaataaacaatttttcagtaggaactcttgaaacattaaaattcccatgaggatctctttctaaaattgattttataagttcaaattgaataaacaaaggcaaagacagataaactcccttcatataatcactaagcttggcaacaaaaatttctttcattttttcaatattaagccccttaaactcaccttcatttttatcaaaaatatcacataattcaagcattaaggacttaacttctggaataaactcaattaaaccttcaggaactataactactccaaaattatctccatttaaagatctctttaaaataacagacaccatttcatcgataatctcagacaaagtcttctttttggctaaaacctcttcagatacaatgcaaatgtttggatgagtttttaaagcacattccaaagcaacatgagatgcgctcctgcccataagtttgacaaaatgccaatattttttagtagacatagcatctctgcacaaattacctatcaactcagaataaatttttgtagcagaatcaaaaccaaatgaaatttcaatatgatcatttcttagatcagcatcaattgtctttggaactccaataacttgaatattttccccattctttttgaaatactctgcaagaatagcagcattggtatttgaatcatcgccaccaataataataattgcattaagattgttttctttagcaacaaataaggctttgttataatgttcttcagtttctatttttgttcttccagaagatacaatatcaaaacccccagtatttctgtaagaatttattaaactctcggtaagttcaattttgtcattctccaaaaggcctaaagggcctcccttgaatccaaaaagctttgaatttggattaaatttttttattgcatcaaaaacaccagatataacattatgccctccaggagcaggtcctccagaaagaataattccaatatttaaagcttttgaaaaagataaacttgactcaccttcggtaaaacttataattggcaatccataagtattcttaaaaaattcttttaaagcctgtctatcttgaattgcttcagtattttctccataaactaaactaatattattaaaatctttttttaaaatatttggcaatttgggaatatacttttgcctttcctgcttaaaaagagaagtattcatacattttcctcctaattaattaaataagcctttatcataaattaaatattaaaataattcacaactaatatctatatattatttagaattaacatagcatcaccataagaaaaaaatttataacctttatttatagcttcttcataaaaactaaacacaaaatctttgcctgcaaatgaagaaacgagcatcaaaagagtagattgaggtgtgtgaaaatttgtaaaaagcatgtcaacaaacttaaaacaatagttcttgccaggataaataaaaagatttgtactttgctgacctgttttaaatttcttaaggttattatcataagatgactctaaagccctaagcgttgtggtaacaattgacaaaattcttttaccaagaagttttgcattctgcaatctcacagccacaaaatcttttattaaaaaagtttcaaaatgcatattatgttcttcaacctttttagatcttacaggaagaaaagtcccaagcccccacatgaagagtgataaaatcatattcaatattgttattttcaaaggcagaaaacaaatctctgctaaaatgtaaccctgcagttgcagaagctgtagatccaacatatttagaataaatagtttgatatcgatcttcatctatcttatcataatctcttttaatgtaagagggcaaaggcacaaaacaatgtttttcaaaataatcttcaccaacattattgttaaattttaaaacaacctcactactattttttgacaaaatttcatccattaatccttcggggaatttgtaaaaattgccaataatttgcttttttgacttagaaactaacgcagtgaataaattagtgtcaattctatccaaaattaaaaattcaacattactgctcatctctgattctgcatatattcttgattttctagcttttgagttattaaaaatattactatttatatattttaaaatattgtttacagaatttttatggtaaattttttgcaattgaggatctagcacgattaaccttgaagatcctcttttttcacttggatattgctctattaaagaatgggataaattaaaatgaaactctttggttttcattaagaccatcctctttcatctctaagtttaagtgaaggtatgcaaactcagtagctttacgacctctgtgagttctactgataaatcctttcataattaaataaggctcataaaagtcttcaagagaatctgctgtttctcctacagaaatagctaaagtatcaacacctacaggtcctccattaaatttcaatattaaacttcttaaaatatttctatcttgctcatcaaggccttccccatcaattctaagcatttcaagcccaattgaaacaatatcacttgtaataaccaaacttccagttacctgagcaatatctcttattcgtcttaaaagtctatttgctatacgaggagtccctcttgagcttcttgcaagaagaaaagcagcatcctcttctatttcaatatttaaaataagagaatttctctttattatctcaacaagctctatttcactgtaaagttcaaatcttgcagtaattccaaatctcgcataaagtggagatgttacttttcctggtttagtagtagctccaatcaatgtgaattttggaagtggcattcgaacagttcttgcattggctccttgccctattacccaatccagctcataatcttccatggcaatgcaaagcatttcttctattattggtctgagcctatgtatttcatcaataaataaaacactcttctcatcaagacctgttaaaattccaataatatcttttggtttgtcaaaagccggagctgaagtaatcttaatagaagcattcatctcaaaggcaataatacttgcaagagtggttttcccaagacccggtgggccacttaaaaacacatgatctagagcctcatctctctctttagaagctcttatgaaaatactaagggtttctttaacattaacctgacctttaaaatcttcaaaaactttaggcctaagctcattttcactcttatcatataaataattttcattagagcttaaaaagcttatactattttcgtctttcataaatattccttaaaaactattttataactataaaaaactaataattaattcgatattctttttaaaacctccttaaataaaaactgctccttttcagaatcttttaaatttgcaaattcagctaaattgaaagcctctctaatcttgctattaacaatttttctatcaaatcccatactaacaattgattcttctaattctttaaatctaaaaagaccagtggattcaagctcgctattaatcaaaagcttaccttgaagatgtaaaaacattttaccagccatttttttgccaatgcctttgattttagagacaagttcaatatcctctttgtcaatagcctccttaaactcattataccttatattggataacactcttaaagcggcccttgggcctactccgcttactccaataagctccttaaagatctctctttcatctgaattcaaaaatccaaaaagttttaattcattttctctagtataaagataagtaaataactcaactttgtctgacaaattaaaattagcaaggcaaaatgcactaactaaaagttcaaattcaaaaacagtagtcattaaaactaaactagattcttttttttctataactttaccatgaatcttatttatcatataattaaattataaattatattacacagaaacattcaacaatttaaagcaaaagccttaagtaaaaaaaggacactaaatgaaaaatcaatttttaaatagctattttcaattaattacaactattttcttaatctcatctataactattgcagcagaagaaataacaagcacactaaaagttcctaatggatttaaagtcgaaatttttttaaacaatacaattgaaaaacctagaggaatcacaagcgatcaagatggaaatatattcataggatctggaagcacttttgcatactttgtaacaaaaaacagaaaaatttataccatagcaaaaaccctgcaaaaacctattggtattgattattgggataataaactctacatatcttctgtcgataaaatatatgtagttaaaaatgtaaaagaagaaattaataaaagcataaaatcacataaagactatacatggaaaatgcaaatttttgcacttttgccaaaaaataattctcaaatgcactcaggacgttacattaaagtagattctaaaaataacaaattaatagtaaatataggatcccagcacaatgttaaaattcccccaaaaaaagaagcagtaatccttagtattaatttaaaaacaaaaaaagaagaaatagtagcttttggagtgagaaactcagttgggtttgattttcacccaattagcaatgaaatatattttagcgacaatggccaagacggattaggagacaacattcccccagatgaaataaacgtaataaccgaatataaagaacattttggatttccctatgtgtttggaaaaaatcaaaaaaattacggtttttataacaaagcacccaaaaacactaagtttatcccatctatttacgaacttcccgcacatgtagctccacttggaatacacttttaccggggaaataactttccaaaagaatacataaataaattattcatagcagaacacggctcgtggaacagatcttctcctgttggctacaaaataacaacactagacattgattctaaaaccagaacagcaagaaattacaagacttttttatatggatttttaaagcacgacaaatctaaatttggacgccctgttgatataatcacatattatgacggttcaattctttttacagatgactttggaaataaaatatacagagtttactacgaaaagatttaaataaaactaacttaattcttctgggatctccaaattatgaattacttcctgaacatcatcaaaatcttcaagcttttcaacaagaagaattattttttctgcttgatctttgtttaaagaaattttattttcaggaattaaagctatctctgccacctcttctttaaatttggttttcaaaaaagataaaactttgtcaaaatcatcaggacttgttataacctctgcctcattgtttgaaactaaaatatcttcagcaccaacttctaatgcaaattccattatttcatcttcaagatatttttctaaattgtaaacaataagaccctttctgtaaaacatatatgagactgaacctggggtaccaagagatcctccaccttttgcaagaacacttttcacatcgctagaggttctgtttttattatccgttaagcatttaatcattagagccactccataaggagcataagcctcataagttatttcaaaatattcaaccccttcattaccaccaatacccttttttattgccttctcaatattatcttttggcatattggcaaccttagccttattaacagctacccttagtctcggattagattcaatatccccaccccctattttagctgcaatagttatttctcttattagctttgtaaaaattttattacgctttgcatcaagagcacctttttttctctttattgttgaccatttactgtgaccagacatttacacctccaacaatttttccaaccgatttaaaacgtcaaacatcctattattaatcaaatgagctttaattgtattaaacattaacataagaaccgtaacaggacctatcccccccttaacaggagtaataaatttaacgcactctttaatattgtcaaaatctgtatcgcctgagagaattttcccgttgtcagtctcaatttcagaaatgccaatatcaatcacataaggctttccgcacaacatgcttttatctattaatctaggcttaccaacagcagaaataacaatatctgcctgtcttaaataaacatctaaataaatgctcttgctgtgacaaacaataacagttgcatcgtaaggttttgatgaaagcaatattgaaataggccttcctacaagaggacttctaccaaccacaacaaccgtttttcccaatgtttttatcccttcatctcgcaagatctttaatacagcaagagctgtacaaggaataaacccttttttatcgcccaaaatcatttttcccaaattaacaaaagataagccatcaacatcttttgaataaactatgctatttaaaatagaatttaaatccatacctttcaaaaggggtaattgcacaataattccatctgtacttaaatttttattttctctatcaattacttctaaaatatcgctttgaacagagtttgcagaaaatttaattacttcaacattcaagccaatctcttttgcaactcgactcttaattgaaacataaagattgcttgcaggctcatcatttgctaaaacaacttttaatgcaattttatctctcaagttatgctgttttaagaattctttgagcattaaataatacttattcgcaaaatctttcccattaaacacaatactcaaaatataccccttaaaccccaataagattaccttaatattatacttagattgtcaatataaggaaagtcaaacgaccaaatttcaaattgtaattaaatttattttaaactataataaacaaggataataattttaaaagaatggagaataatgagaaagtatatttttataatactaattgcagtcttgctaattggtgtaaacataaaaaaaattgcggccgcagccaatattgataggcatacaaactccactttaggaatagatttaagtgtaggaatccctattttttacaacgacttatcaaaagcttatcctaccaatttatatccaggaggtattggggcaataaaataccagtaccatattttaaacaatttagcaattggacttgaactaaggtatatgtttaactttgatattaaccattcttttaatatattaaatccagattcaagtgtaggtaaaattttttatagcgtgcctattacattttcaataaattatatatttgatataggagaattatttcaaattccagtcttcacaaatatagggttttctcttaatacatatggagatagaaacaacaatattacaaatttaagaacttttgatgcactccctacaatctcttttggatctggaattttatggaactttaactataaatgggcttttggagcaacagcatcttggtggatgatgtttgaatttggaaattctgctaaaatggcacattttgcacttgtatcattatcagttacagtgaatgtaaataaattgtaggataaaaatgaaacaaaaatacgaaaactattttaaaaaaagattaattttaaacctattaatatttttactactagcatgctcaagcgaatccatattttcacaattaggaaatctgcaaaaaataaaacatgaatacaatattttgggcagttcaagtccaagaggaatttctctagtaggagaaactctctacattgcagccatgcatttatttaaaaaagaaaacggcaagattgaaaaaattgatttgagcaattcttatgagtttataaacgacattgtaaatatatctggaaaaacctatcttttagcgcaaaacaaagaagaagaattagaagtttgcgagctaaatggaaaagattggacattaaaatttaaaaaaccgctaaaagcatataaattcttaaaatccgtaggaagagatggcgtaaaagaagcatatattttagctatagataaaaataatcgtgagaaaatttttgatctacaaggatctgacaaaacaccaccacaagctactgaaaatgacaaattttatcaaatatcaaatgaagaaaacttaattacaggaaattcactcaaaatatggcaaatgaataacaatacatacacaaacatagactatcaacaggccaaagaaataatgcctatcattaaaacaagcattaggggctcttctgaagttttagtaatgactggtggttacaataatttagatacaaaatttaaagtttactcaaatacaaataattacacaacgccaatatttattcaagacgaagtaggcgaatttagcagctactttgcaagagaatttaatgatgcgatattaatcggaagtaataatggatttgcagaatttacaaaaaataaagaaggaatttttgccctacgggcaccctcaaaatctgtagaacctggagcttataacggatctcagctaagcaaaacaggccttaatgatattattcctgtatcaaacaacacgatttacatattaactcagggcaagggtttgtggaaattggaaaacagaaaattaactaaagaataaagaataaaaattcgttataaatttttcatatctagatttattaaaatcttcatcataatattttttaatcttaattttcaaattgaaattaatcttagatctaaaatataaataatttatattatttatatcaaaaattcgaccttcatcattcataaccttaaccccaagatctaaaagaagcttggcaaaaaaaatatctcgagtaatcacaaggctatatctatctgctaaattcaaaataaatgaatcaacattgtctaccacttccaaagcaacattttctgttatttccagactgaaaaacttattagaaactacaatgagttttgatttattgtgcaatataaatttttgtaaaaattttattatcttaaaattacaagaatcagcatcaacaaaaattttacttaacaatcttatagtccactaccttaagaaccaaaaaagaaacaatagcatttttattaatgggtccaaatattctagaatcatttaaaacgcttaaattgtcatttaataaaaaaaattcattttttttcaaagtaaaacatttaatcacttcgtctgtattaaaaaaatcattcaacttgtaatagctaaccaaattgccattcaaataaaaaaaatttgtatcctttttatttaccaggacattcaaacctctaacataaacagaatcgccctgaacagctgctattcttgatactttatagcttgctcttttaaaaattttatttaaaaaaaagaaatcttttattaaagttaacaaaaaattattacttaacctaaaatcctcataaagaacaatatcattcattttcaaaggaataaaaaaagaagttatgtgtgttgctacaaaaaataaactggcattttttgttattgttggtaacatctcattacttttaatcataaaaatttgcaaaacaaactttgtgaaaaaaaaatttaaaattaaaaatgttaaaaaatatttaaaaaaaacttttctttgtcttttccttaaaagcctttgttcgaaagttaaatatggggccactttaaataaatcctactctagaaaatggaagatatattatcaaggttcttccaagtactttattcttattgattactccaaaaaaccgaccatcatgagaattgtctctattatctccaattggcaaaatatatccatcaggaacataaataccataatctctcattatagctttttccatataataatccacataaggcataaaagcagataaatacttatattccaatctttcaaactcaaacctatcaatcattctaacatcaaaaaatgaaaaatcgggagtgctacttaaatttatatttaactggctaagagcaacaaacatagcaaaatcaccataaatcccatagtcctcatttgccacaatttttttaattttaaaatttttatcaaccaaatcccaataagaatcttctaaaataaaattttcctcgccttctcttttaatataagctttaccgttattaaatctaacaattttaccatctgcaaacgcacctcttttcacaagaaatctaacattgggattgccatattcatctctatcaagatcaataaaagataatgttaacatgtaaagtattctttgaaagatatcaaaaaaaacaccctttgatttatactctggattttcaaaaataataatatcggattcttctggggctttaaaaccattaattttaaataaccctggtaaaagctcaggaccgtaagaaaatttatctacaaataaaaaatcccctatttgaagagtattttccattgatcctgatggtattttataagcttgaacaaaatattgatttatcaccaatacaaaaattgccgctgctacaaaatcaaataaaaagttaagcaaaaatcctcgtttcttagcccttaatttgcaaaaatatttctttctttttctatatgtcaaatatttctcaacaatgtgtaccaaaaaagatgcaaatttatccaatcttcttaaatacataacctaacctcaagaattaaataatacaaaatattgacacttatttaaatacttttctatactttaaaagatgaaagaggttgacgagaattcaaatgttgagctttttgaagttaaattaaagccaatcctaggaatagagcctaaggtttacgtatttcttacaacaataatattgcttttaagtttaatatcaactttaataatcatacctaaatttaaaaatccaggagcatatttaaaaataaattccaatattgaaaacacttacatatatttaaacgaaaaatatatcggtagaaccccacttaacaaatatataaatgccaccgaaggagttcttagagcaaagagaatgggatttaaaacttacgaacaaaggataaaaattcacaacaaattttttggaaactacagtttgcaaataaatttagaactggttgatcctgaaaagatcattaaacaaagacaaaaagagctctctataatggtgaaaataaaaaatattaatgaaaatacaaaactaattcctgttttttcattaatatctagcgaacttaaagaacatcccaaatacattaaaaaatttctaaaagattctataccttacttaaattcaaccgaaatgtttaaagattttctaaattcatataaagctatatattcaatagaccaagacaacagcaatcaagaagaaatatggaactctttaaaaacaaattttgatttagaaaatagagccatcttttggtttttagaaaatttagataaagatttaaaaatactaacaaaaaatgcgccttgggttaaaacattagccaaaactctagacaatgaaaatattcaattaatttctaaaaatgaaaaaatcaatataaaattacctggatttaaaaaaataaattcaaataaaatcgaaaaaattcaaaattatgaattaaattcattagattcaaaaaacatttcactaaaatctacctataacgtaaaagaatttcttattcaagaacaaaatgttacaaaatacgagtatcaagattttttaaaagaaaatccaaaatgggcattaaataataaagaaaatttaattaaagaacaacttgtagatgaaaattatcttaaaaattttaatcaaataggcttaaatgaagccatcactggaatatcttatttctcagcaatagaatacgccaactggtactctaaaaaacttcccacagggttcaaagcaagactgcctatatcacaagaatgggaattgtaccaaaaagaaccaaacaaaaacccattaaatattaatgaaatatcaaaaaaagttggattttggaatttaatgcaaaattcatcttttaatgaaatcgcaatatttaaaaatgaaaaaaatttttatagcgaaaattcaaatttttactcattgataacagaaattagaacatattcccagcaaaataataatttactcaatgcatcaaccaaagcctcttttttgaaaaactggagttctccaaacattggctttaggttgattgtatcaaaggaataaaaggaatagatttgaacacaaacaatttgcttcttgaaaacaaaaaagcaaaatttaattactttattgaagagaaaataagttgtggaatagtgctaaaaggaactgaggtaaaatcaataaaggcaaaaaaattatcatttaacaatagctttgcaagcataaaaaaagaagaattgtggcttgaaaacttgcacgtatcaaaatataaagaaggtaatatcttcaatcatgatgaattaaggcccagaaaacttttaatcaaaaaaagagaattgcaaagactaaaaaaatttaaagaaaaagagggatatactttaattcctattagtttttatttaaaaaaatcaataattaaagtagaagttggaatatgtaaaggaaaaaagttgtatgataaaagagaaatattaaagcaaaaaagcataaaaaaagatcttagtagagaaataaaatacaagtaaaagctcttttaattacaattgagcaattgcaatacagaattgcaatcacccatttttgtaataaataaaattaatagctttttttgaaagacagttcaaacccaagagcactggattggcccattgcaacatcaaaactaggttcaaatcctcctaaagctacattaaggctattttttagcttcctattataactattagcaaatgtaaatggaagaataatttctgttaatcttgtcacagccatagtaaccacacctgctaacataactcccttaccccaagtccattgaaaagcagcttttttagtaataccatcaagcgctttgatatccaaataagcccccgcaagtataagccctataccaaccgcatcaaatccaagaataagagaacctccaagaatatctccttgagcaaaggagcctattccaaaccctaaaaaaaggttcaataaaaatggtacaataggatcttgcttgctagtttcataaaccaaaagtttttctccagcactcatcccaaacgcaccatttttagaatcattagcttgagcaaagctagaaaaaacacaaaaggttgccaaaacaaaaattaaaagtttattcataaaaacccctttattaaaactggtactatggtagcatattaatgaaatttaaaaaaggtttttaaagttatttaaatttaacttttttcaaattattgcttgaaattcgcttcccaatagagcttcttgatttgaccataaaattatcaatttcaattcttttaacaatgtctttatttgtagaaaattctacaaattctggattcaatgaaaaatcgacaaattcatcattttctcccaagaattcataaaccttatctgtaataaatttatctattttaaaccttttaacataataaaaattgtcaagcctgttaaaataaattattgaaaatatttgctcttttgaattatttatatcataaactaaagcacatacattctttttatctataaatgtcttgtcttcaatatttttaagaacataactattttctctaaaaactaatattttatcataataactagcatttccaataaattcaccatcaaaaagacttgttcctgcaaagccttctgccaagttcaaataaactttcatattctttgtagctatttcttttacattctttgatttgattaaagaaattttagtctttctttgatgctctttagaatactttgcaagcaataaatcaataaaatttattgaataacctcttattgaagaaatattgctatttatactctttaattctttatttaaaattttaatatccttagaattcttatcaatatcaaaaagacttatttttctaattggaattttaagcaaattttcaacatcttcttttaaaacttcccttgaaaaagattctttgtgccttaaaacctctgacaatattatacttagaatattttcttctttagaaattgtttcaagaagtttataaatctttttttcaataaaaatttgctcgagtgttttataaaatattttttcaagaatcttgcttttttgtaattcaagttccatttttaaaattttttgaagatgggctgcatgaaacttgataagatctttaatagtataaacaacaggatatctctcgctaagcaataataaattaacagaaattgatatctgacaatttgtataatgatacaacttttcaatcacttcgcttgcataaacacccctaggcaaagatagctctatggccacattttcagcagtaaagtcattaatgcttgaaactttaatataattttttctaattgctttctcaatcgaagatattaagctctcagtagtctcaccaaagggtaattcccttattacaattgttttttcatctatggtttcaatcttagctctaactaaaactttaccgttaccatcagcgtattcgttaacatcaactattcctcccgttggaaaatcaggataaatatcataactctctccaagaagctcgctctttactgcatttaaaatctcattaaaattgtgaggcaatattttagctgccattccaacagcaattccctcacttccttgaattaaaataacaggaattttggcaggataaagcaaaggttcattatttcttccatcataagaagattcataaattgttatctctttgctgtaaagaacatcaaaggctaagggagttagcctacattcaatatatctagaagcagaagcaggatcacctgtgaataaattgccaaaattgccctgcttttcaataaatagatccttattggcaatattaacaagagcctcataaattgacgtatcgccgtggggatgatatttcattgtattaccaacaacatttgcaactttatgaaagttgccatcatgcatttcaaaaagagaatgtataattctcctttgaactggtttaaacccatcaacaacactagcaatagcacgatctttaataacataagatgaatattgcaaaaaattatctttaagtacagttctaatatccattaaatcaaattctccataataaaattccgcctctcaggagtattttgccccatataaaaacccaatttctcttttatttctttaatattaaaaaggtccacctttgtaagcttaatgctattaatatcaataaagcctttaaattcatttggagaaatttcaccaaggcctttaaaccttgttacttcacatccccccttaagctcaagaatggctttttgcttttcttcctcagaataacaataggtcgtgatttttttgttcctaaccctaaaaagaggagtttctaaaatatacatatgcccatttaaaattaaatcctcaaaaaaagttaagaaaaaagttaacaataaatttctaatatgaaatccatcaaaatctgcatcggttgctattacaaccttattgtaccttaaattttcaattgattcttcaatgccaagagctaccatcatattataaagttcttcatttttgtatatttcagatttattcttttcaaacatattttgaggttttcctctaagagaaaatatagcctgagtataaacatctctacaagataccattgaacctgttgcagaatccccctctgttaagaagatcatagtttgttctgactgcttgctgctgtcattaaaatgaaatttgcaatccttaagcttagggattttaaaagatattttttttgctctctctcttgcttcttttcttacgctacttaattcttttctgagtcgttcattgtcaactacttttttctcaatcaattttgcaagtattttatctttatataaaatttcagaaattatcttctgcacttcctttgcaacattgcctctagtttcaatatttccaagcttattcttagtttgactttcaaatattggatctttaattttaacagaaagagttgcaacaagcccttccctaatatccgtagaggaatatgtttttttaagaaaatcgttaatagctcttacaaagccctctctaaaaccagtctgatgggtacctccatcattagtatattgaccattaacaaatgaaaaataagtctccccataattatttgtatgggaaaaagcaaattctaaagttttactagaatagtaaacaatatcataaagcaaatcatcacttttaatttctgaattcaaaaaatctaaaagaccatttttagattcaaaaatttgatcattatagtttattataagtcccttattcaaacaagcataatggaaaaatcttcttttgagaaaatcttcactataagaatattttccgaatatttctgaatctgctaaaaactcaacataagtaccatctttatcagaagattttatttctctagattccaataattttcccttagaaaacaaagcctcaaaagatttgccatttcttgttgatcttactaaaaattttgaacttaaggcattaactgccttagttccaaccccattaagccctacagaaaattgaaaaacatcgtcattgtacttggctccagtattaataactgaaacactctcaataacttttccaagaggaattcctcttccataatccctaatagaaataagattattttctttttttataaaaatttcatttccgtaacccataataaactcatcaattgaattgtctattatctctttaattaaaacataaataccatcatcaatattagagccatctcccaaacgtccaatatacataccagatcttaatctaatatgttcaagagaagatagagtgattattttactttcatcataattttgagtcttcatctaaatccttgctttataaattaaattttaatagtttcaagctttttaactatttgatctctaataatactagtgagattctctttttcatactcacttaattttaaaacatctatcaaaggatggacatgaatataaacagacagtccagaattaaaaataatatttttaataaaaaagttattagtattataaagagtaacaggaagaattgatgttcctgtttttaatgccatcttaattgaaccttttttaaaaactctagtatccccccctctatttctagttccttcggggaaaattccaatagatctaccttctctcataacctttattgccttaacctcagcagcagcagcagatcttatgctccttctattaacaaaaataacacccataacaatcaaaacaatattcacaaaaggaatcctaagcaacgaatgttttgccaatattacaaatgggcaggcaaaagtataaataaaaattaaaggatccatagccgcaatatgatttcccattattattacattgctttttttaggaatattttcagaacccgtaacaataattttaattccagcaagccataagctaattttaatgcaagctcgcatcataatgaaactaagcctaacaacataacgttcaattaaaaaaattttacaaaccaggtaaaaaggaaataaaaaaaaaattaaaatcaaaaaaaacaataaaacattaaaataagttataatacttctcaatattttcataaaaactattatcatattttttctattcgctcaagctttaatttttgccctttaactaagcttacatcatcttttaaaattttaataggatttaaaatgattgtagaaaatttttgcttttgaacaattctttcgctatgctcaaggaaaaaagattcaacaagcttgtaactacccatgtcaatctcatattcaagaacaaaattattttttaaaggaaaaatattaaaaatgccataataaattttattctcatcaatataagttaaatgggggtaagaaaaatcataaattttatccttatacacgtaatttccactaggaataaaataaatatcactactcccttttttaacatttaagacattctcatcaaacctcttaaatgtacccgaaaatccactattatcataagaatttgtgctagtgtcaattttgatttcaatgttttctttatctacaattttgatccaaaagttataaactatcaaatctgaaaaaagagactttgcactaacattaagagtattgtaagcaggttttgaaatatattcaatctttgcaacttcttgagaatttttcctgaaaagattaatctcgcttgattgcctttcaaaagacaagaataaaacttcatcaatatctttgacatgcattttattatagtcatgaacatcataccaaactccatgcaaaaatttataaacttcatctttgcttaaattctttaaagttttataaatattattatcaattttaccaactttttcgctcacagaagaaagacaatatctaccctgaacattagaatattcatatttttcaatcttgctaattattaaatcttcccccactttttcatatttttctaaagaaataggatagctttctcttgatctgttttcttcataagctgaagatcttgcatacttattaataagaacagttccattaactttgtcaaaaaatataggcctataagaagacacatcatttaaaacagatttttgaaaaacatacaaaacagatttatcttttaaaaatccttgaataactatattaaaatcataatcacctgtaatatcttcaagatacatgttataagaattttttggatcaatatctatttgagttttaaaaagaatcgttccagctttaattttaggatcaaaaccaataataaacaaatatgcattaagatttgaaaaattttgagctaaaaccacctgctcaaaatacacatctaaatttaaattttcctgctgaactgaaagaattttataaccttttaaatctataatatctccaaaaaaatcttccattttattaacttctaaaacattggaatttggattatcgatcctggaagaagtctttacatctttgttaaaaacaataaaatctttgcttaccttggaacaagcaagtaatgtaaaaaaaaagaataaaaacaaaaatttataaaatgggattaattctttatccttactcagaagagcaatcgcactaacaaccaaaacctttgtcataacatttatttcttaattttgactaaagttttgcaaagcaaaaaacgactcattaaaattattaacaaaatcttttttattcagtaaaaaatctgtaatcaaaccactatttgcaatgttaaaattgtcaagaattttttcatttttgatctcgtctttgagctgattagatctttttttaactgaattgagaaaaaataaataaacttttttatttgccacaaaaggcttagaccaagaattttcctttaacccaaaaataatatcataaaaagacttgctattattaaactcaaccaactcctttaaagtattggggtaaacattaatattataagacaaattaacaatttcttcttttaagctaagctgatatttttcaagaacttggcttaaactgctaaatttaacatcaccaagaaaatcagatagcttattttccaaataaccttcaataacacttggttcataagtttcaatgtaatttttaacagaactaatatcacgatctgaatttttatcaaaatcatgaacattactaaatgccttatatatttgatattcatttttatttttaatcttaataggcttactaaattcaccttctcttaaagaaaaaatggaatttagatcttctttcttttcaacattaagatctaaatcaaaataatacttatccaaagaaacaactcccttgaaattggctatatcatctgaataaagcttagcaagctcctcgaatggagttttgtttaatagcttatcatgagcagtccgagcatcattcatatttttaaaacgaatagatgcaagcgataaacgtttgaataaatttaaattcttctcagcataagatattacctctttattagaaaaatcttgataggaaagagaaagatatgaaatatgcctttccacagtactcatatttttaatcatatcaaaaagagagtcgggaaatatcaaattactatttaaaaaaattttaacattagaaaacaatatattttctaccatatcatcataaattttaactttttgataatcagaagctttattatatcttttagaactgaaatttccactagagtctaaatattctggagatttaagtaaatttttattcaacatttctttagaaatataaaaattatatttttttactaggtccaaaaaagcaacatcctcaacatatttcataaatgccaaataccaggcattataatctgtattaatatttttagcattaccctgcaatctagaataaagatttgaataataattaacatacttggcaaacttactatcttttttatagtaaataggttgacctttataagaaccaaattttaaaccagatgaatgagcattatcaaatatccctggaagtaaaggtgcaataataaatccgaaaacaatcaaaataagagcaaaaataccccacataccaacttttttttctttagattcaagcacaactaaatcatttttgacttttctacttctttttcgcataaaacaacctttaataagtaagcatactaataatttaactactaaattatcacaattgaaaaattattgcaattgaaatatctaacttaagctatacgcttaagtattatagaactaaaaaaattttacatttctagtatgaaaacgaatcgctatggataaaaaaggagaatgagatcaaaagtatatgaacacgaatcaaaacaaattcaaccttaatataaatataactaaggacgaactttcaagattaataaaaatagtttacaataattttggaatcaatctcagcgaaaaaaaaaagctgctaattgaaagcagattatcatctcttctgaaagttaaaggttttaaaaattttactgaatacatcaactttttagaaaaaagcactggaaatattcaattaatcgaattaatagacaaaatatcaacaaatcatacctattttttcagagaatctaagcattttgattttttaaataataaaatattacccaaacttactgaaaaaatattaaactcagaaaactcagaaattagaatatggtcagctggctgttcaagtggtgaagagccttatacaattgcaatgatgctaaaagaatatatggaacataatagagtaaattttaaagtcaaaatcttagcaacagacatttcaattagcgttctaaatgaggctcgtgaagggatttatcctgaagatcgcataataaatttgcccaaatatttaaaaattaaatatttaaatcaacttcaagatgataaatttcaagttaaagaaattttaaaaaaaatggtttactttaaaaaattaaatttaatggatgagaaatttccatttagcaaaaaatttgacctaatattttgcagaaatgtcatgatctattttgatgaaaaaactaggaataaccttgccaataaattcaactcctaccttaaaaaggattcttatcttttaattggacattcagaaacaatcagaggaaacaaaaatcttgaatacataatgcctgccacctataaaaagaattaatgcttatgcgcatcaattctttttataataaattttctattatgcaaaatttatttagcttaaaaggtctaaaaataatactgctaagttaagtttactttttcacctattctaataaaatagagcaattcaccaattgttgctacatgatcgcctactctttctaaaaaactattcaaaaataatatatttaaaagataatccaaattttcaggattttttttcattgcatcaataacaatacttttctgctttgaaaataatttatctattatattgtcatacttaactatctttaatattttggtaaaatctccatcaaaatatgcgtcaaaaatatcagacaacatttctttagctgtatcggccatttctcttaaaggtttaaaatataaattaagaaaatcaaaatcatccaaatctgattcaagtagaagaacaacctttacaatcttagtagcatgatctgcaatcctttcaagagagcttattattttaataattgctaaaatttctctaagctctgtagcaacaggatgctcagttgcaattattcttccgcacaaatcttcaatatcgtactgataatcatctattattttttcatcttcattgattatttttttggctaaatttttatctttagattctaaggctattaaagaatcatcgataatcttaagcacacattctttcatatcccaaagataatcttttattatttcaagttgtttagtaagctttctccttatcatatcatgtctcctaaaaaaaccgctttaaaaataaatatcttatcttggctctctcataataataactaaaagggtaattatcaataaccaatttatagtaatgcaaagcctttaaaaaatctttatgcttgctctcagactcataaagttttcccaacaaataactatatttgtctgaaaagcttgaattaatatacttaggaaagtaaagagagctaaaatttaaagcaaactcatgctctccccttgttactaagaattcaaagatctcaagataaatgctctcagaaaaatcaacattcttttcaactaaatatctagcgttctctaaaacctcttctttaatatttaattctatagcaagcctaattagatcaaaaacaatgctttgaaaatatttactcttcaatttcaaataattttcataagattttaaataatcaccatttttataatgaatttccgccttcaataaaatatatttatcgtcattgaaattatacttattaagcaaatctattgctcctttgtaatcatttatgtaggacaaatttaaagccctaacaataatctctttagaagttgccccgctaatactcccccccccaagttcaagattattaccagtttcaatgttattgtccctgctagagccaccaccaacgccttgtggaattgcaacttcaaaattctttgtaattttcaagataattattttattaaattcacttgaatctttaacattttgataagtgaaaaccaatttaattttgccttcttttttaaaagtctgaaaagtaaaaacagcaccgttatcataagattctccaattaacttaataaaagcttcattttcaatgcttttgatataaatccaagactcatctttaaaagaaagattaaattttgaattggtatttacactaatatctacctctccactactaaaatcaagctcatacgaatcgtcttgacttataaaagctggcttagagtaaacttcaaaaacaataaatagcaaacttatataaatcaaatattttctaatcatttggaaatttctaaaatcttatctattaatttttcattctccttctcaatatcaacgttaaataaattttcctttttaatccaaagatccttgaaaaaattctcatcaagaaatttatttttaatcaatccatcaacaactaaattcttatttaaattttcatttaaaaaatcaggtcttggaataaaaaaatcatccatatttagacattcatttaaatcaaaataaaaatcttccatatcaactaatttaaccttagcgtctaaattgtcttcaacacacttttgagatttttccaacatttgtgttgaatagaaataagtaataccagaaacaataaaaatcaaaaatactgaaattaaaaaatattttctaaaactaaactttctatcttgcatgttaatttccttaaatctaacttaattatatattaaacaccctgctttcaccattatcaagtgtaatacctatcaaattttcaccaccctcagaaacatatgcattatgggttattactaagagttggaactttttacccaattctcttaaaagtaaagaaagttttttgctattttcaaaatcaagagctgcatctatttcatcaagcatgcaaaaacaagcaggagaataataataaagtgcaaataaaaaagccatactaaccaaagtactctcgccccctgaaagcatgttattgtttttgacaaacttgtttgaaaaatttattctaatctcaacattatcggtattttcattataaaaaagactagcggttcctttaaaaatttttttaaaaaagaaagaaaaatttttattaatctcatcaaatgattctctaaattttttataaatctcattttttatttttttttgaagcttttgtaatgaatattttgaaagctttaaatcttctacttgtaaacttactttttcaaaacgctccttagtttcatcaaactctttatcaatattgaaaaatacataatcacccagcttgattgcatctatctctttgcgcaacaactctctggttgcaagatcttcttccaattcaaatttatcagacatttcattagaaacattgaaattttctatttcgctcttaatgcttacattagaatttaaaagaaattcgtattctgtctgtttttttatatattcataataattagtttttttaaaatcattcaaaaaaactaaggaattaaaatctttctccttaaaagactcactactgaattttgaagcaccaataagattgcttaaattaagctgaatatcgcttttttctaaatttaaattttcaagctttaaatataagtctttaagctcttcatcaaggctattcttagattcaaataaaaattctaaattaccatctataagtttaatttcatccaaatttttaaacttagaaagctctatatactcaagctcacccaatacatcatttaattgaagagtcttttcttcgattaatctctcgatatttgttatctctttagcaagatttgattttaaagcatttttttcaagcaaaaattttttcaaattaacattttgatcaaaaataggttcaattttatccctcaataaagccaaaagattctcatctttgcttatatacttgattaaatttaccctaatctctttaatatattttatactcaatgattcttcaaaaagtttaagagagtctaatatatgctcttttaataaaacaaactcttctgatttggcactccttaatacagacaaaattagatcaacaagttcaaaaaaacttttagtatacctattaatctcgtcacttaaagaaaaaaaatcatttttcttttctttaagcaaactatttaattgatataaattattatttatagaattctttttctcttcagactcagatttgctcttgacaaacttatcttccaaattcatctttaacgtcttttcttgctctaatttttgaattttaatctctagcccaagaattttagacttcataagctcaagatctttttctaattcttgaatattattaataacatttttttctctaaatgaataaaattctaacttttctttaaaaccagaagacaaaaatttactcaaaccgtctaaatttaattcgctcttcaagacattaagatcaaaattaatattgaaaagcttttttaacgttattgttttttctaaagcttctaatttttgacttaaatcttgatgtttttttctcaaaaggaaaacattttttatgttatcgtacttttgccttaaattttcttgcagagacaacaaagatgataaattttgactagattgcttaaaatttttcaaggcctcttcttcttccatttttaaaatatctattccgcttgcttgttcaatcaaagatttgagatttacatttctttccaaagaaatgtcctcaaccctaccttgagttataaacatataaggcgattttttaaacttaaaactgttcaaaagtctattataatcttgaaaattcaaaattttattattaaaataatattcacttgaaccatccttataaagacgcctgcgaatataaaaatcttcattaaattcctttaaagtcgatttttcagagttaatgttgctaaaaaaaagagttatttcggcaaaatttgattttcctgattttgaaacagaaattaaatcagaaatatcttcaacccttaaaaattttaaattatcttctcccatacaaaaacgtacagcatcaataagattgctcttcccacatccattaggccccacaataaaacttaaattttcacctatttcaaactcttgtctatttagaaaagatttaaaccctaaaagcactattttttttaaaaccaaactaactcccaattaaaattaaaaaccaattactgataaatctacaatttcatattataataaataaaaatattttaaaaaaaggtcaattatgatttgcggaatagatgaagtcggaaggggttgtatttttggacctattctaagtgctgctgtggttttcaaaaaaaagcccagctttataaaagaattggatgattctaaaaaactaaaaaaagaaaaaagagagtacctatcctcattaatacttgaaaactcatattatgcatttgctgaaatttcaaatataacaatagaaaaaataaatattcacaacgcatcccttcttgcaatgcaaactgcatacgaaaacctaaaattaaattgcagcttagtacttgtagatggcaaatttgtacccaaaataacagcaaaaaatgttaaagcaataattaaaggagattcaataatagatgaaataaaagctgcttcaattattgctaaagttaaaagagacaaactaatggataaatatgataaaatttacccattgtatttactcaaaaaaaataaaggataccccacaaaagaacataaaaacgcaataaagaaatatggggtcttaagccttcatagaaaaaattttaaactaatttaaaaaataaaaataataaaatttaataatccttctttttaaatcgcccgcctgataaatgagatttcttatcaaatctagaatcgtctaatttagatctctccccatattcaccataccctttattatgccttgcagaagagccaacggaccccgtagatactttctgcttaataaccgctattgccttaagcaaattggattcaaactcatttatattctcttcatatacaaaaatagaatgtctttcaaaatctccacttggacttcttttgctctctacaatatttaaaaaataatctccttttctattttccttgacattaaaaaaataagttctctcagactctgtaaatagtttttcagagtatacttcccctctctctcccatcaatttcctccacacaagtttttgtacttgactacatttaagctaaattaattgtacttatttaaaaaaaaaattgctagctaaaaataacattacaataaatcttattgacataaattgattttttttatataagtaaattattgtattgcgtccttcgtataatggctattaccttagccttccaagctaatgatgtcggttcgattccgataggacgcttaaaataatgacaacaaattttctaagcttagcaatgcttgttgggaataagaattatgtttaaaggataaaaaaaagaataaaataaatggagatggcgggaattgaacccgcgtcctaaaaataatactataagcttctacaagcttatctagtattttattaagcaatatggtttggaaatactagcaaaccaccaaattgctctcaagtataaaagtccctaaaaatcaacttgaaaacatttttaagcaagctttgatgtcgaaaagagtataagtgaacctcaaagccaaattcaacaaaaccctctgctaacttaagcagccattacaagatttgagcttgtaaagttattattttttgcatttattttagaagttttaagagattccctctgcctgcaacttacaatattaacattttcagtcaaatccaaaacatcccctcatataaaggttattatagcataattttaagaaaacaacaatacttaccgccttatttgaaaaaactaagctaaaattttataatagtaaatcaaatatcagtaaaaggtaattttatgtttaatgaatttttatggtttggcgtgctatttaccacttattcatttttgattattgtatccattttttttaaaaaaaacggattatttgcatgggttgcagtagcaattattatagcaaacattcaagttttaaaacaaattacaatatttggaattaatgctacattgggcaacattatttatacatcatcatacattgcaacagacatgctctcagaattttatggagaaaaaacttcaaaaaaagccgtttatattggatttatcagctttattatctttgcagtattaacaaatgcgcaaattcactttatgtcaaataggactcaagaaaattttaaaagtttaggaaacattttctcttcaatgccagctttactactagcctctcttgttgcatacctaatatcccaattaaacgatgtttatctatatcagcttattaaaaaaaaatttcctaggtttttatttttcagaaccaatggatcaacattaataagtggcttaatagatacaacaatttttgtaggcatagcaacatatttcaaagtatttccaaaacaagctttcctaaatatagtaattttcacatacgtaattaaagctgtagcaggtgtcttgggaacgcctttcatatattttgcaaaatatataaaacttgaaaaatgaaaaagttatttgcaagaataaaaaactttatctaagataatcaatctgctacaattaaatgttatgaataaggatatgtttgatttaagcttgtggacaggaatgtttctatttatatatacagcattgggaattctttaccgattttttggaaaatctgggcttttttgtttcaatgcaattatttcaacaatgtcaaacattataatattaagaaatttaaaaatatttggaatgtccttaaatttatcaggcattacctttttatcagcagcattctctttaaacttaatggtagaaaaatacagcaaaaaagaagcaacaaaatccgtggtattgagtcttttgctaaacataacttttacaattatgctttattttacgatactattcaatcataataaattagacaccgcagatattcatcttaaaatactgtttaataactctacatacattttaacaatattaattggaacgtatgtgttttttctatcccaatatacaaacatcttactatataattatttaaagcaaataaaaataaaatctttatggatcattcatcctctatcaagactaatttctggatatctggctaattttctagtttcaatatctataaatacaatacttaaattctaccctgaaacaaaaaatatcgaacttacaaaaggctctctaattattacattaataataattgcaatcgataccattttttacctatttataaattcttggaaaaaaataaaagaagcttaagaattaataagattctcaataaattgataatttttaacaacttgtctataatattttaatctcaaatttgatttctcagcttcatttagcaagtaatcaatactactttttcttaagcgcatcaataaagaatacataactattgcaacagctacagaaatattataactttgagtaaacccatacataggtatttttacatataaatcagcagctcccaatacctctgcactaagccctgttaattcagtcccaaaaaatatcgccattttattgttaattgtcaaattttcaagatttattgatttgggattcaaagatgtggccactatactatatccatcagatttcaacctatcaattgcaaacttagcatttttatacttatttaaatttatccattgtgaagatcctaaagtaacatctggatttaaagtatgcttattctttttttcaatgacatgaacatcactaagtcctaaaatttcgcctgttctaatagtagcacttgcattttgagactgaaaaatgtcttctagaacaaatgttaaataattggtacgaagatttaatactttctcaatcctagcttttttttcatctgtaataaatttagacaaaacacctattctttttaatacatcatcatccataataaaaattaaatttcaaaaataacaaatcagtcctttaatatatttcaaattgcaaactatttcttatataatacaaaaatgaaagtaaaaattgaagaatcttggaaagaagttttaaacaatgaatttaacaaagagtactttaaaaagctcgtgaaatttattaaacatgaatataaaacaaaaaatggaaaaatatttcctcccccaaaactcatattcaatgcttttaattctttaccatttaaagacataaaagtggtaataattggacaagatccataccatggaaaaaaccaagcaaatggacttgctttttctgtagattcaaaaattaaaattccaccatctttgcagaacatatttaaagaaatagaaaaaagcttaaaaataaaaaccatcccaaacggagatttaaaaagatgggcaattcaaggtgtatttctaataaatacaattttaacagtcgaagaaggcaaaccttcttctcacaaagctattgggtgggaaatttttacagatgaagtaataaaaataatctctaaaaatttgaaaaacattgtgtttatgctttggggcaatttagcaagaagtaaaaaagggctaattgacccaacaaagcatctaattcttgaaacaagtcacccatctccatattcagcaaacaatggatttttaggatcaaatcattttagcagtgctttagattatttaaaaaaacacaataaaaacataataaactttcaataaaattaataaatttaataatggttatgatttaaaattcctttatgtaaaaaactctgagtaaatactactcatagtatacacaacagtaaccaatttaaattatttttctttcaaattgttttctttaatttcattaatattagcatctgattcactattctcatcatcccagaaagttgaactattcttgttttcagtctttatgtcatttagaaagctatcatctgctcttctggtgtttagaaaagataacaaaactacaaagataaaaaagagtgctataaaaaatccagtaatttttacagcaacacttgaagactttgccccaaaaatagaagaactaccacccccaaaaacaccacctattccatcaccctgctcatcttgaattaaaactaaaaggataataaaaatcgaaacaataacaaaaattataaaaataaaaaatctaactaaatccaaaacaaacctcttcaactaaagaacattgttaattatagataaaaaagattcggcctttaaagatgctccacctattagcgcaccatcaatattaggctcattcataagctcttttacattgtttgaattaacagagcctccatactgaattataatattgtctgaagctgactttgaataaagcttcgtaatctcaagcctaattgccttatgaacctcttctgcctcttctttagttgcggttttacccgttccaattgcccaaacaggttcgtaagctaaaattatcctttgaatatctgattcagaaacacaatttaacccctttttaacctgatttaaaacaacctctaaagtttttccagaatctctttcatcaagagtttctccaacacaaagaattaagtatttgaaaggatgcttaagtcctgcaagaatctttttatttattatttcatctgtttctgctaaatacaacctacattcagaatgaccaagtataacatattctactccaaattctaaaagcattgaaggtgaaatttcacttgtccttgctccactttccatataagacatattttgagcaccaaggagaatgttactacccttaatacattctgaaaccttagataaagccgtaaatgggggagttatcattattacaacatcatcttttaaggtcttaacctcagttgcaattttttttgcaacaatagaagcttctgcacttgtataatgcattttccaatttcccgctaaaaatgtttttctcattttaattctccaaaaccttaatacccggcaaaattctcccttcaagatattcaagcgatgcaccaccgcccgttgaaacatgagtaatcttatcagataaattaaatttattaacagctgcaacagaatctccaccaccaacaacggttaaacctgagcaagatgctaccatttcggcaaccttagcagtcccttttgaaaatgaatcaaattcaaatacaccaagaggaccattccaaattatagttttggcagttttcacaacattttcaatttcttttaaagtattagctccaatatccatgccaatcttgttttcaggaatattaaaggagtcaatatactcaggaattgaatttttgttaaaatcatcagctacaatatgatcaagtggtaaaattactttaacgcccagctcttttgctttctttaaaaaagaagatgctataccaatatattcgtcctctaaaagagatttgcctatagaatatccttcggaatgcaaaaaagtataagccattccaccgccaatcacaactacattagactttgacaaaagtgattctagtaccgcaatctttgaagaaaccttagaaccaccaataattgaaacaaatggcctttcgggattttttaatattccaccaagaaatttatcttctttttccattaaaaatccaccaacagacggcaaataatcagcaactcccacagttgaagcatgagctctatgagctgcgccaaaagcatcatttacaaaaacatctccattttcagaaagtttttttgcaaaatttttatcgtttttctcttcttctgcataaaaccttacattttcaagcaatacaacatccccatccttcatttgcaaggtactatttacaacctcacttccaatacaatcagaaagcatcttgacatcttggcctaaaagctctgacaacctattggcaaccggcttaagagaatatttaggatttttctttccatctggtctacccaaatgacttacaagcacaatcctagctcctctttcttttagatactctattgtagacaatgctgccctaattctagtatcatcgctaatgctcccctcttttaggggaacattaaaatcacatcttactaaagctcgcttgcccgcaaagctactaaagtcttttactgtttttattgacattttattaccttaagcttacttattttaccaatttttgagcaagatcaaccactcttgtagaatatccaaactcattgtcataccatgacaatatctttgcaaatccattttcaagaaccattgtctcaagaccatcaacaatagaagaatgagaattcccctttatatctgaagatacaattggatcttccgtgtaccccaaaatacctttaagctcaggcgtttctgatgccttcctgagcacagaattaatctcttcttttgtaacatcctttttcttaagttgaactgtaaggtcaactattgaacctgttggcacaggcaccctcattgaagtaccattcaacttacccttaagttcgggcaaaacaagtccaactgcttttgcagcaccggttgaagttggaataatagaaagtgcagcagctcttgcccgtctaagatcagaatgaggaagatccaaaattctttgatcattagtataagcatgaactgttgtcataagtccttgttcaattccaaatgattcatgaagtacttttgcaagaggagccaagcaattggttgtacatgaagcatttgacacagcctttaaatcagaattaatatcgtgatcatttacaccaagaactattgttttaatctcgtctttagcaggaactgttaaaataactttcttagccccagcatgattcacatgatcaagatatccccctttatcactagttgctgatgaaaaaacacctgttgactcaattacaacatcaattccaagctttgcccaaggaagattttttgggtctctctcagcaataatttttatttctcttccatccacaacaatggcaccatctcttgactcaacttttttattatatactccaaaagtcgaatcatactttaaaagatgtgcaagagttttaggatctgttaaatcatttattgcgacaatatcaattcctctttcaaaagcaatcttaaaaacatttctaccaatacgcccaaagccattaatagccaatttcatacaaaatcctccaattttttgattttattcttactagaattattaaatcacaaattaacaacaagtgtcaaactatctttttataagcacagtggctccttcttgaacataatcctttaaaaaggtagaagattttacaatgcctctagaaatataatcacttatatcctcaattaaaatctcgcctaaaatatctgattttttgtaaacaataaaaccagaatctctagtatcactgtttaaagcaccttctttaagaatcaaaaaaacatcgccttttacaacaccgtttacttggccaagattaataagagcatcgtcatttttaatttgaagaatctttccttttttgggcaaataatcatgaaaatcttttgaaagagaatttaaagcattgcttaaataattaacacctcccacatcataagagaaagaaacaagcttaatccctgttttacctgaaaaaatattcactaccaaggtagctgtatttttcaaaatatctgccttaaaatcaaaaattaaaaataaatccaaattattatttcttgaataagaaaacccttcagaaaaattattaatcagatagtctctatttttattgtaatcaaaattatagttaactatttccatatttaaattacgctcaagcaccctttcagcgtatctcaatatcaaatcatttgccccaaaaaacttattctcactttgagtaaaaatagccattttataaaccactctgtcatcgtaaagcttattaaaatcagcaatgcttttgtatccatatttataaaataaagactttctaacatcaaaagacacaacatcgtaaaaatctaaaattctagaatcagtagaatttctttgttttgctaaataaaaaagctgctcatatgccataatatctaaattcataagcttgtatatttttgaaagcaaaaacctagcactatcattatcaggccaaatatcaacagcattttttgcattaaacaatgctttgtttaaatttaaagatttaaaagctttaagcccctcattttcataatgcttagaaattctagcattggaattatttttcaaaaaatttctaaaattagatgcaaaaaaactctcctcaagagcaatattataaaattctaaatcttttttgagatttttagctcgctctaaatttaaaatagccttttcaatatctccaaatcttaagtaagaataccccaataaataataaagctcatcagaatctttattaactaaaatagctttctgcaatgcttctattgcatcctcatatttaaattcatgcaaataaacaagcgcaagcaatcgatacgcatcaacaactccaaaatctttgtaagagctttcaattaaagccaaataatttaaagcatacttttcagcaagccccaaattattaatactaatataaaattcagcgactcttttatgaaaatctggaaaagataaaaaatttaccctgactttatttatcaaatgtctaatcttgtcatgcattcctagcctttgataaatgtcaataagatgctcaaaagcactataattattttgactataatcaagaatagataaataataattagcagcagctataaataatccatttttttcaaaaattgaagcaagtccaaccaaagcatcaatattattcctttgtttgactaaaacctcagaatagattttttttgcttgatcaattttatcgttttttaacaatatatttgcataaagaattttatattcagtgtcttcattggacattttagaggctttctctatgaaaaattgtgcttgagtatatatcttaagggaatagtaaattgatgcaataaatttataagcttcataataattgggattaatttttatagcctcaacaagctcatcaatagcatcataataccttttagataaataatactcattagccctttgataatgtcctaatgctgtagtatcacttcctaatagaacactaaaattaaaaaggaataacattaaaaaccaattaaaattcataaaccttccttctcggaaatctttatcaccttaatatttctttgatgcatatttttaatcgaaaaaaccaaattgttatattccaccttttcatttttcaaaggaatcctcccaaaaagatcataaacgaaaccgccaagagtatcaaagtctccatttggcaaatttaaattaagtttctcatttaaatcctctattaaaattcttgcatcacaaagataagatccatcatcaagacgaactatttcatcaagctcattgtcaaattcatcttgaatgtcacctactatctcttcaagaatatcttcaagagttacaagccccgaaaccccaccatactcatcaaccacaattgcaatatgaacatgattttcttgaaattcttttaaaagagagtctgtttttttgctttcggggacaaacatgacctttcgcataatatcttttaagtctatttcgtagaaatcttttttacacatatgtaatagtatgtctcttgtatgaattatcccaacaatattgtcaatggtaccatgatacacaggaaatcttgaatgactgctagatgttacaacttttaaaagctcgtccttgctcttagcataatcaacaaatataactcctatcctaggaatcataatctcttttacaacagtctctttaagcgcattgaagttttttatcaaagaagtttcaatattcgacttatcttcaagatcattttctgggcttccttttttcttctttttgtttttaaaattaaaaaatcccaacatctaaaatacccttttattttcttttaagatattttcttgaagaatcaacataccttccttttgaaaatcattagtttcatgtttatatcccattaaatgcaaaatcccatgaatagtaacacgttgaagttcttcataaatttcaacattaaactcttgagcgctgaattttaaatattcaaaagatattacaagatctccttgtattttataatttatgccatcaaccaaatcttcgttaagctcattatgttcattataattaaaagaaagaacatcagttggctcgttcttgtttctaaatttattattcaattcttgtatataagcattatcacaaagaataactgaaagttcaaaatcgctaatggaaagagcattcaaaacagatacaacaaaatcataaaaaacattaagatgttcaaatttaatattttctaccaataaattcaaatcagatttggacaaattaaatataccctaaaataatccacatataacttacaagtatgattaattgctatagcaattaaattattttattttgcaaactaaaaaccaaaaaaatccttaattatgttttcaaaagcatcttcttgcaaaaagccaacagaaacctttggcttgccatcaacaggaataaaaagaatagttggaagactttgtactccaatcgcagaagaaatatcttgttccttatctgtatctactttgtaaaaatcaatgctattctcgtactttttagaaagtttttcaaaaatcggagaaagcattttacatggaccacaccaattagcataaaaatcaattattgcgggtctatcacctctaaaactccactctttatcatttttataatcaaaaactttaacaacaaaatcttcttcggttaaagaaatagccatatattttacatgcccccctatcgacttaaaattatatcacaaatacaatattaataataaggaattataagaaatgaatctaatgttaataacttttaatgaatttaaaacaggaatttcactcaatgatactagggcagaacatcttgttaaaatcttaaaattaaaagataacgacaaatttaaatttggtattcttggagaaaaaaacatttaccactgcatttacaaaaaagataaaaaactatttttcaagaaaatctttaaagtaggtgaatctaataaacttaaaaaattatatgtgctaattggaatgataagaccaattgttgccaaaagaatcataaaagaacttgctagcattggaacatacaaaataattttttttaacactgagcttactgaaaaatcatatttaaattctaaaatctttaaaaacaatgattgcgaaaaacatttaatagccggagcaatgcaaggaaaaataacatacttaccaaaaataaaaattataaaaaatttgaaagaaagccttaaatatattcaacaagaaaattttgaaataaaaatattgcttgaaaaaaatagtgaaaaaaatttaattgatatagaacaaataaacaatgcggtcattattgtgggacctgaaagaggatttacagaaaaagaaaaacaattaatagcacaatataatttttccccttacagcatatccacaaacaccctgagaacagaaacagccacaattgctgcatctattattacagcatcaaaactaattaatatgtgattttatattaaaaatttttttatcattttaaatcaatatgtttttgagcacaattaatttataactgtttgattaatcagcttatcataaatataaagctcaatcatagaacctttattaacctcatagggcaacttaataagtcctccctttgacttaaaggaataaatcaaagaatttttaccatccacgccttttaacctaacagatatatcgacataagatggatgttgtcttaatttataagtcaaaattccaaaaacaattttattgtcaaccttgggctttgcaatagtaattaaaattttatctgattcatttattttagttccaggcggaatagactgagaaataatatttccaaaatcgccgatatttgccaaatcaatgtcaaagttaatgctatcgcttaaaagagaagcaattgcatctttataataaattccaacataatttttaacatgtttgtccaaatgatctttacccttactaattaaaaattgaagatccgttaaacttgatatttgactacccggtgatggattttgactaattattattccttttggcaattcgctttcaacctcaagaggttgaacaatatggtaaagtaatttagaattatcaaaagaattggcctttaaattaataataacatcgtcaatgtttttaccaataaaactatcaactctgtttattatagcccctttgctaatgaaaattataaccttattgccatgtcttaaaacagttcctggttttggaccctgatctattactttccctttatcaagagcacttgaagaaaatttaaattcaatgtgcggaatcaactcttttctctgcaattcaagaacagcatcctcaatagcaagagaataaagatttggaacgactgtaatctcattattttctaaaaccataaagaaaattgcaaaagaaacaattaaagatccaaaaataactaaaagcaatgccttaattgtggttttgggcaaaatcaacatttcattattgcaatttttgtcactctgagacagatctaatttatttttaaacaattccccttcattagaaaatttattttctagattgtcattattattaaaactaatatatccccccctattctattgaagaaaacacttgccctattagctgcctacttccattataaaaggacttaaaatccaaaacctttcttccaggtctttgaacttctaaaagcaaaagaatccctttcccggtattaacaaataatcctttttcaggattaaaatcaacaatttctcctatttttctctccttatataaatctacctccaaaaaatcggcgcgatgaaaaataatgtcgttataatcaagcctaactcttacaagtggccaaggattgcacgcattaattttatttttaatctcaaatgcacttaaattaaaatctataaatccagattctttttttaaaaaagaacaaaaagtagcttcgcttgatttttgaggaattcccaaaaaacccttgctaattttttccaaagcttctagaacaaggcttggactaaggcttgatacaagttttgaaatatcatgacttgtatcataagatcttattttaaaatttttttgcactaaaatattgccactatccatttctaaagccatactctgaatagtaacaccgctaacacaatcaccatttaaaattgcagattgaatcggagaaacgcctctatatttgggtaaaagagaaggatgaacattaatacatccctttgggaaaagatctaaaaattcttttttaaaaatcttgccataagaaaaaactaacattaaatctggattcaaatctctaactaaatttaatacattatcatcaagaatcaaaggatcaagaactttaatattcctagcaatagcctctgactttattacattttgacttaacttttgtcctctacccttgggtctatcaggcaaagtcaaaactcccaccacttcataatgctttacaatctctttgaaaacttctaaagcaatagaagaagagcttacaaaaaatattttcattttgccttaagccccctttctctcatataaggctttagtaatttattttttaacttttcttcgtaataatcaataaaaagaactccatttaaatggtccatttcgtgctgaataattcttgccaaaaaatcagaattttctatagtaaaagattttccattctcatcatgaaaatttattacaacagctttaggcctcattaaatcataataaactcctggtatactcaaacacccctctttgtaagaactaaactcataagaagtctctatgattgaaggattgataaaaaccaaaggccttgccattttattctctctaactacaaaaagcgccaaatcaaggcctacttggggagcagcaagcccaactccaccgctaatatccatcaattctatcatctttttagcataatctctaatcttatcgtcaatattctcgatttgctttgtcttaacacgaagcaaatcattaggataaaataccatttccataaaaacccatccccctttcaaacaaaaaagacacttattttatttttccaaaaagcttccattcttcatttcccaataatgaaaaataaatattaccaatcctagacttaggaatagcataaagcttgttttcattaatatctttaaaaactaaaaattctttaagatctgtatcaaaaagaacaagctttctgtctttaccattaaactttaatcgccaatcaccttttaatgttttgtaaaaaaaggttctctcatcagcagtattaatttcataatctttttgcttttttaaaacacttgttgattttatagctcccataacatagtttaaaaaatccttatcaaattgaacactgctcaaaacagctcccacataagctgcctttatttgctcattcttagaatcaacaaaaaaaatagtcggacttttttgtagattaattttattaaaaatttcattatccttatcaataactaaaaaaacactttttctagatactttgtgaataatttcaccatttgtaaaagagtttaaaaaatcttttattaaattttctttaatatctctaccaaccaaaattaaaacatttttattcaatttttgagcttttttaattgcaacctcataagaactctcaaaaataatatcttccggaggcaaagaaaacaaatttgaaaatccttgatttaaaatcattaaaaatgcaattataaatctcatattttacttgttagctttgctaaaaattccaactctccttcattatcaaagcgctcttttaatgttaaaaatacacattcatgataatcattgatataatttaactcatcttctgagagcatttcttttactatcaattccttttcaaaaggaacaagggttaaattctcaaactctaaaaaagctccaaagtcatttgtaaaagcttgccttacaaaaactaaattctcaattcttattccgtgactaaatgttctataaagaccaggctcaattgaaactacctcagatcctttaaaaagataactagaattaggactaatagaaactggaagttcatgaacattaagaaaaaacccaacaccatgcccagtgccatgaataaaattcaattcattttttaaaagcggtaatctacaaattccatcaagaaaagctccggaagatccatatggaaactttaaagaagaaaggccaatgaaagccttaagaaccaaagtatagtcgcgcttttcttcatcagaggcatcacctattaaaaaaactcttgtaacgtctgtcgtaccaagtccaaaatatgaacccccagaatcaatcaaaagaagaccattggtatttatttttctacctcttttgggcttataatgcggaagagctccattttctctaaaaccaactattgagtcaaagctagaactaaaaaaatctttattcaattttctaaaatgcaaaagcatatcagcaacatctatttcatctaattcagacaattcaaccttgctaagacttttaaatttacgtaaaaatttaatcaatgcaatagcatcaataatatgcgcttctttcatcttaagaagttcataatcggtttttaatgccttaagactacttataatactctctcccaaaatgatattagtctcaccaagaacttttaaaaccctaacattggcataaaatgaaacaaaaaatttaccttcgtgctttattttgtccaaaaaacagtaaaaattgctgtaagactctatttcaaaattttccatttcaagtgcttctttaacacccgaatcaagtttttttrtgtcaacaaaaagaacattttttcgatttttattcctagatattaaaagaaacgaataaaataatgctgattcttcaacatctgcccctcttaaattcagcacccaagcaatctcatcaagagcagtaataacataaaaatctgccaaattcttttctaagatcaaataaatagatttgattttttcagctcttttgttattcttctcagcatcagccaattcaaatacatggctaaactcaagctggggtctagatttccaaattaaatcaattagatcttgatttaaagccttgatatgtgtatttttacatttttcagacaactctttataaaactttatactaatctcatctgaataaattccaagctttgattctttaagattcaaatttatatacgtaaaaatatcaggagatccttttactccaagctttattaatgcaatttcagttcccttaagctcttgctcggcctgtaaaaaatacctaccatctgtaaaaagaacagcttttgataatgttataattaccgtaccaaagctaccagaaaaacctgtaataaacttacgagtgctatatctttcatgagaatattcactaaaatgaggatcatagcctgctaccaaataagcatcaaccccattatctctcatatgatctctaagcaaagctaatcttttattaatatccaaaaaaatcccctttatacaaccttactaatattagtataccaaataattatcaatttaaaaaaaaaaaattatttgatataatttagcttgaaattaactcctaaaggataaaacatgaaaaatattaaagcggttgcctctgatcttgatggcactcttttactatcaaaaagctatattggagcctttacagaacttgtaattaaaaaattaacaaaagaaaaaaagaaattcataatagcaacaggaagaagtaaaaatgaaatcattcaaattataaaaaaaacagatcaactgcaagtttcatttttcattacattaaacggagcaaaagtttacaatcaagaatggaaattaataaaaagtcataatttatctgctgaagtggtaaagaagattttaaatttaagagacgagaaatttagtcacatacctcattttttacataaagcagatcaaaacgacgaccaattaaatattgacatcaagactaaaattgcaattgatcaatgtaaaaaattgcaaaaagaatccaatgtcttcagacatgaaataatcagcccaatcaataaaattcaagaaattaaagactttaacgagcttaaaaattttgaaaatgttgcaaaaataatactagctggcggagaagaaagcctaatagaatatgaagcaatgattttagagaaatataaaggagaaataaatgcatacctttctaccccaaattcactagaaattgtagatcataaagtctccaaaggtaatgcattaaaagaagttcttaaaactataaatattaatttaagcgaaaccatagcttttggagatggctttaatgatactgatatgctagaaaatgttaaaaagggattactaatgggaaatgcaaattatagattaaaagcaatgcttccttacttagaagtaataggaacaaatgatgaagaagctgttgcaaactacattaatgagaatgtcttagaagaacctatttaggaggaataaatggagaaagatttaataaaatatgcagagcttataattttaaagggaattaatttgcaaaaaaatcaatgtgttttaattcaaggttcaatcgacaattataattttttgaaaatattagcaaaaaaagcttatgaacacggggctaagtatgtcaagctaaacattaaagacattgatattttaaaatcaagactaaaattttcacaagaagaaagcttgaaatttattccaaatgcagaaaaaagctttttagaagaaatggttcaagataaatgggcaagaataaacgtcgatgatacagaaaattttgaagacttaaaagaaagcattggtcaaaaaatgtcaatttatcaaaaagccttaaatttggcaagcaaaaccttatcacaagcaataatgagcaacgaaatagcctggtgcgttgtttgtgcaccaggtccaaaatgggcttccaaagttttaaataaaaaagaaggaagtcaaactttagaagaatttttcaaaatacaaaaaaaaatattattactcgacagtgaaaatccaatagaaagttgggaatcccatggagaaaaacttcacaaaagatgcaaaacattaaatgaacttaacctagaaaaggtaatttttaaaaccgaaaaaacaaacttggaagtatatctgcttgaaacttccctatggacaggtggaagcgaaaaaatcaaaggaacagaaatagaattcaatgccaatatgccaacagaagaggtttttacaactccaaactataaaaaaacaaaaggcatcgtgtacgccacccgccctgtaatggttcttgagacactaatatatggaatgtggttaaaattcgaaaatggaaaagttgttgactttggctgtgatgatgagaagcaaaaagaaatattaaaatcacacattgaaaccgacattcaagcaaaatatataggagaagtagcattagttgacagtagctcccctatttatcaaagcaatcttattttttacagcacattatatgatgagaatgcaagttgccacatagcactaggagctgcatatccatcttgtttaagcaatgaagaagatttaaagaccgatgccgataagctaacttacggatgtaacgtttcattgatacatacagatttaatgattggaagcgatgacttaaatgtcattggtgtagacaaaaatggaaaagagtacacaataataaaagctggtaaattcgcaatataaaaggaggcttaataatgataagggcattgcttaccaatgatctttttttgtcttgtcttgtatcaggaatttctgctcaagtgattaaatatggtatccaaactgtaaaaacaagaaagttaaaactaactccagtacatcttttaaaaaaaatttttctagaaacaggaggcatgccaagtagtcattcatcaacggtcaccgctctttcaacctcaatcgcactaactgaaggaatagatacaaattttataatagctcttgcatttgcccttattacaataagagattctttcggcgtaagatatatgtctggagttcaagcagaatatttaaatgcattatcagaaaaattaaaaaaagaaataaaaattgacacaacaaaaataaaagtggtcaaggggcacaaaaagaaagaggttctaacgggcataataataggaatagtctctgcgtatattgtgtgctatttttagcataggaaaaaataaatggtgcgttttttaggttttttatatttaattacaacaataccacttatcaaatcctgtgatgcagctcaatttggagactacaaacctttatactttgaaaatgaaaatgatctaaaaactgccaatgaatatataaattcactaggatacaaaacaatctcagaatacacaacaaaaattgacattttagactttcccgaaaataaagaaatcacaataaatgagataaacaaacttaacaatcttgacctgagaaaaagcatatttttaaaaaagctctccaatcttttcaacatagagcacaaaaaacttctttatgttgaaaacaggtttaaaagtataaattttaaaaacctaaaaaaagaactcaatattaatgccgacatacattctcttgactacaaaacaaaaattaattttatttcaagcataatatttctaatcataataattttattaatttttttagacccaacaaactctatatttactttaatttttctattaatttcatctcttgcttttatgataagcaaagaaataatgtatttttatccatttacagttctctcttatttgttatttttaataatcagtaattttaacaaaaattacaataaaatatatttaaaagaaataaattttttaacactaatgacaaaaataaaacacttactatttttatttacattcacagctctatatttcattacaatcacaaccttttttactacaaatattgatcccacttttattgcatttgtcgcaataccaaccctttgcattttcttaattttcagctggataaaaacagaaagcaattttaaagacactttcttattcccaatcgagattaaagagaaaaaaatagaaggaaaaaaagctttaaaatcaaaaatagcaatacatctactactatttacactctcattaattcctttcgcttattcaagctatatgctaaattcttatgaaaacattaactacctttacagtaaaaaattaaattactttgattatttaaatcctaataacatttatataatgctgggatacaacaaagacatgcccaatattatagggtacctatcccacattctttatcaaaacgaactaaaatacaatattaccgctaagtatggaaaaattcctaaagatataaaagaaaattactttgaaatcaaaaacgacaaaatagaaattcatcctaaaactgtttacgaagtagacaaatcatttattgatgaaattcttaaaaaagatcttgcaagtctgtttttaaaaaataaaaatccaatcctaatatataaagaaaacaagaataatatcaacacagataaaaaaaattacaaaatacttttctttttctctttgcccttctttgtattactattcctatttaaagcaataagatttacaattcttttaaacataaatgaaaaaacctataaaaaatatattcaaggataaatagctaatgctagacttagaaaaagtaaaaacaatttttaaaaaatacaataaatacgaaataaatattaacgagattcaaatacctgaatatgccctaataccccttgaaacagaaaattcaaaatccataatatacataattgaaaaacaaaaaatagaagaaaatcaaattttatccaaaaactcaaacatagagctatacacatattctccaatatctggaatagtagaaaaaatatacacagccaattttccagatggaaaaaatttaaaatcagcattaatcaaatttcaaggaaaaataaaaactgaaaaaacaccaattgaagaaggagcctcaagagaaaaaaccttggaaaaattaattcaactgggaattccttggtttaacgaaaattctttatttcaattcataaacaaatgtaaaaaaatagacaaaatgattttattaacaaacggaaaagatgcatttacaaatatttcagaagcactgatggcagaaaaattagaagaaattttttcaggattccaaataatcgacaaaatattcaaattcaaagaaataataataataatatcaaataaagacaaactaaaaaaagaattcgaaaaattgagtatttttaaaaacagaaaaataaaaattaaatctttagaaaatgcatatccttatacaaatcacgaaatgataatgcactttttatacaataataaaaatacaaaagatgatataaatccccacaacaatattttattagcaaatattgaagatctatacaatgcaaatcttgtcataaaaaataacaacccttataaagaaaaatttgtagctataaatggaaataaaaaaataaaaagtagaatactgaaggtaaaaattggaacctctttcagccagctaataaatgagaaaattgacacaaaaaaatatgaaatttttttaaacaacccagccaataaaataaaaatcgatacattaaacataccgataacaagagatatttatagtctcaccatattaaagaaaaagtcaatatacgacaaaattaaagcattgtttatatcaagctttgcaccattgcaaatggaaaatattattttttcattcttaaagaaagaaaaaataaataatagcggcaaattaaaaatatttaattatacagacaaagaagtagaagaagaaatacataaggttcaaaaagaaattaaaagcaaaattctaaatgaaagtctaacaaatgaagcaatatacactgaaaacaatttaaaagacatatactttgctatcatactatcactatcacctagcctgatattttctttcctaaataacacaaaattcatgacagacaccttgctgttaatatttattagtgtggcaatctatatacctataatgctaaaaattaattacaaatgtttgtctttttttgtttacgccgccttaatgataagcattatattgcccttggatttagaaattacactaaaaataatttccttattatttacttttttggtattcttttactttttcagactatcagcatttttggcaaaccctatattaatttcttttatgtttttggtattaaattttccggtaagttttaagcaagcctatcaagaggaacttaaaaattcaaattcaataattccaacctggaatgaaataattgaaacaaatccaaacataaaaaatttaaaaagtttaaatacctttacaagatatgaaagtaaaaaaatagatgcaattgaaaactttgtaaatcaaaacattttttccgcttttaatataattgtcacaagatttcatattgaaagtcttttgggagttaataatgaaaaaaaaatatctcctatcttgctttattttggcctcttattaatagttggcaaatatataatcaacaaattaataccactctcattttatataagcttaatggcaatctcgtacatagcacataatataggaatgctaaaccacatcagctccgacatgttaacactacttatttctccaatcccaatgctgttaatatttacaatggcaacagaattgcaaataacacctcactttaaatttgagcaaatactctacggatcaatattggcatttatatactttttgacattaagctacattccttttgaaactttatcagtcataatatctattttcatcttacaaacaagctcaaacttaataaaaaaatatagcttaaccttcaaaattaaaaaaataatgcatgttttgaaaacaaataaagaaaaagcactcaaaacacctcttgagaatgaaaaggatataataaaattatgaccaataatttaattgcatgcctaattattaacaacttaaccttaatacactttgttggatttgaggacataaaaataaaaaacaatataatgctaataaaaaggtacgccataataacaattacttctttattaatatattcaatatcgttttatctctataaactgtttgcaaagaataatttactgttcttagtgccaattttttatgtaattttgatttacgtgttgatattattatttaaagtattaaatgatttatttattgtttacaacaaaaaatcaaattattcaaacgatttcatgctttcaaatagcagcttaattgcaataacattttttgcgcttgataagaacaacggattttttgaaggattagaaatacttattctatctgcacttggcatactaatagctttaatgtcaataacatcaataaaaaaaaactttgataaaaaccccaaaatcaatatattggaaaacgaaccaatatatttttttataatatttattttatctttaattccaaatataattatattaatatacaatcaataatagcgagaaataaaaatgaaagaaaaaataaatacattgctcaaacatgccgaagacatttggaggaagctttgacaaaaatgaaattcaagctaaaatcgaaaaatatgaaaaagaaataaaccagaaaaatttttggaatgatcctaaaagagctcaaaaagtaattaaggctcaaagtattttaaaaaataaaattgatccgtgggaagagctaataaataaaataaaagacttaagcgatttgtgcgaaattgccgaaaatgaaaaagatactaacggcttggaaattgaatttaatacgcttgaaaaacaatacaaagatttactcacaatttcttactttaaagaagagcttgacgcaaacaatgcttttttaactattcattctggggctgggggcactgaagcatgtgactgggtcgcaatgctttacagaatgtattcaagatacgctgagagaaaaaaatacaaaacagaacttattgatttactcgaagcagaaggtggaataaaatctgttacaatagaaatcaaaggtgagtatgcttatgggctattgaaaagtgaagttggaatacatcgtcttataagaatttctccttttgatgctgctaaaaaaaggcatacctcttttgcatcagtatttgttgaccctgttattgatgacaaaatagaaataacaatcaaaccagaagacataagaattgatacatacagagcatcgggagccggaggacaacacgtcaataaaacatcctctgctgtaagaataactcacattgaaacaggaatagtaactcagtctcaaagcgacagaagccagcacaaaaacaaagacttggcaatgaaagttttaaaatcaagactttatgaatactataagagcaaagaagatgaaaaaaacaaatccaagcaagacacaaaaaaagaaatttcttggggcaaccaaataagatcttacgtatttcaaccttacaatttggtaaaagatcacagaacaaaatttgaaaattcaaacaccacttcggttatggacggaaacatagacaatttcatagaagagtatctaaaatggaaaagcttaaactaaagctagcaataccattgctagtatttacaatatgcaaaatacattctcaaagtaatattgaatacaatttttcctatatcattaatacaaaaaaagaaaatattgacctaaaaaagggtattgaaaaacaattggacaaaatctatgataaaataacagaacatatagtaaacaatgatgacaagagcatcattgaagacatttatataaatcaagatataataaaaacagaacttgaaattagcaaattaaaaaaagaaatggataaaaaaaaacttcaaaacataataaccgcaaaagaaaagcataacaccaaaaccaaaattgatgagcttaaaaaaaatattcaaaatattaacaataaacaaaaaaaatttgcagaatattttaacaatttaaaaaaactaaaagtaaaatataaaaaaatcgaagagcaaacaaatatatcaaatttaaataaagaattttttataagagaagaattattttttattaactatattgatcttaaaaaaatagaaaattattatttgctagaaattagcaacatcactcctgagaaaattgagactaaaaaagcggtatttaaaacatcatcttctgttaatgaaattgcagatcacataacaaaatacagcctcaaagaaatattgggcagagaatttttaaaaatcaacattaacgtcaaaaataactcggatgcaaaaatctacataaatgaaaaatttgtttcaaaaggaatctatcacgataatatttttgacatttctaaactcccaaacaaagaaattgaaatacaaatcacaagtgcaaatttcgaaaactattctattaaaagaacggtaaaaaatgcagactcaataatattagatattgacttaaaaagaacaatctctaaaaaagtatcaattaaaagcaatgtacaatctaaagtttttaaaaaaggaatatttatgggagaaaccccaattgaaattgaaaaaccagaaaatcaagatatcatcttgcttaaatctaaaggatataaagataaattcaagttaataaataaagaagaagatcaagtagaaatagaaatgataaaaactaacaaaaatagacttatcgacacaagagataaattttatgtcaatctggccgtctttacattaagcacaataggagccatttttgcaggaacattgcttaacaattcagaagtactttataaaataacaggcaatcactttattaacaaaagattaacagcagaagatgtttatatggcaaaagcggaacaaatgactgcaacatttctatttggagtaggaatcactttaactattggaagctttatctcattaataactcatttagtagaatatattaaagaagcaaatatgggagaatagatttaataatctgcaataaaataggagaacaaacttttgggcattttagaaaaaataaaaaatttatttaaaagcaaacaacaagaaaatgttattgaaaatttagaagacattttattagaatcagacattaataatgaaattgtaatagaaataataaataaattaacaaaagaaaaaaatgaaaacgaaaaaactattattggaaaactaaaagaacttttaagcagctatattaatacaaaaaaatttactctagaaaataacaaattaaatattttgttaatagttggtataaatggaattggaaaaacatcaagcatagcaaaacttgcaaataaattaaaaaatgaaggcaaaaatatattaatatcggctgctgatacattcagagcagctgcaattgaacaaatgaaaatttatggagaacaaatcggtgttagaataatatctcaaaaccaaggaagcgatccatcagctgtgatattcgacagcatatcaagcgctaagcttaaaaattacgatgcattaattattgacacagccggaagattgcaaaataaagaaaatttaataaaagagcttcaaaaaataaacaatgtaatattaaagcaaataaaaaacaccgacatcaattaccaaaaaatacttgtaatagattctactattggaaaaaatgcaaatagtcaagcagaaatttttaataaagcaatagaaatagacggaataataatcacaaaacttgattcatcctcaaaggcaggtacaatactaaatatttcaaaaattcttgaaaaacctatatactttactacctttggagaaaaactagaagatattaaagaatttgatataaatgaatattttaataaattactatgaaaaaaaaacaattaatacttcttctatttatgccacaaattatttatgcaaaaagctattttgcatctgatgtatttttcaataaataccaaaaattaaatgaaaaaccaaaaacggggttttatattgagtattattctgttgatgatactgaaaaactctacctatacaaagaaaataacttaataaaatacaaaacaattcaaatcatagaaaacacaaaaaaaattacatgttatgatacaaaagatacaaaaagaaaagaagagatttacgataatttaaataacaaaatacaagaaattgaatatgatagcaaaggaaaaactcttgaaacagcaaattacgtttatgaaaacgaaaacttaatatctaaaaatttaaaaacaataaaccaaaaaccaaaattaatatattattctaaagacgacaatggtaaattactaaaaataacaggatcaaatttccaaatttggaactatggaattaatggcgacataaaatctacatattttgacatcaaaaaagcaacaacaaaagttataaaatatgatgataaaaaaagaaattcaaacagtacaataattgttaataataaaataaaatccaaagaaaaaaaccaatatttagatgaagaaaaaatagtaaatacctttgaagaagagaatacaaaaatcatatctacctacaaggcaaacaacctaattaaagaagaaacatataaaaataatgaacttataaaagtaaatgattttcaatacaacgaatctgatatgataatttttcaaaacactaaagaaaaggataaagaccaatacaccaatactaaaattgaatacgaatataacaaagacaatcaattaaaaagcaaaaaaatttatgagaacgatataatttatctaaaaactgaataccacaatgacaatgaatatgaagaagaaatatactacaataaaaaacctgctcttagggtaaaacacaagaacggaaaagtcaccgaagaaaaaccaataggaacaaattaaatgggtataagaaattttttgcttaaaagattaatactagaagaaaaaaatagtctagccctcacaattgtaataatattaagcattgccttaggcgaaataataattatcctaacaatatcaatcatgaatggttttcaaaacgatttttttcttagcattacaaatgtagaaagcggaaacttaaaaatagaaaatgaattaactcaagaagaaatcaaaaaaattaaaaagattgaaggaataaaacatataaataaaatatacgaaacacaaggcattggaattcaaaattattattatccaactattttaaatatcattgcagttgatattaaagatctcaaaaaagaccaaaattttatttcatttacaggacttgaaaaagatgagctggatcttaaagacaatgaaatcattattggaaatgtactctctcacaatttcaacttattcgaaaatgatcccctagaattaataataaccgatgaaataaaaaacacttatatcgctagaaaatgatataaaaagctttaaaataaaatcaattttcaaaagtaattatgcaaaaataaatgaaactttaatttttatgaatatagactatttcattaaaaataaaattttacataattctggtattaattaccaagtaaaaacaaaaaatttaaatccaagtaacaaattaattgaaaagattaaagctgttaatccaaaaattaaagcaaaaacttggaatgaatacaataaagaattctataaaatattaaaaatagaacgaaatacaatgttaattattttagcaagcattttcattgttattgccgttaatacatattatcttcaaaaaagaataataataaacaaaaataaagctattttaatactattagccatgggacttagaataaaaaaaataaagcaaattttttttattcattcaataataatttgcactgtaggaggacttcttggcttgacactgggaatttccatttccctaaatataaatgaaattttaaaaataattgacaatctggtaaacactttaataaattttttaaatcaaatattggctttaaaaatagatggcattaaaatacaaatagtaaaaaatacaattactcctaaattatttttaagcgatttaacatttactttctgctttgcatgcttttctacaatgtattcaagtatgaaggcaacaaaaaaaattggaagtcaaaaaaacattgaaactattaatggacagtaaaatggagaatatattaattataaaaaatctttgcaaagcatataaaaaaaataaaacaaaaattcaagtaatagaaaatctaaacttaactgtagaaaaaggtgaatttatttcaattcaaggaaaaagtggttgtggaaaatcaactctttttaacatgatttcaggaattgataaaatagattctggagagataatatcgtgtggaatatttttgaaaaacgcaaatgaaaaaacattaagtttgtacaaaaacagacaaataggcttagtatttcaaaattataatttaataaatgaatttagtgtaattgaaaatataattttaccccaaattatctcaggccaaaaaacaaaagaaacaataaataaaaaagctttagatctaatgaaaatattaaaaatagaaaacagagcaaatcattacccttcagagctctcaggaggcgaatcacaaagggttgctattgctagagcattaatcaatgaacctaatataatattgtgtgatgaacccacgggaaatttagacttaagcacagccaaaactgtagaaaatctacttatcaatacagcaaaaaattttaaaaaaaccttaatactagttagtcacaacccacaatttgcaaacaaagcagattcaaaatacgaattcaaagataggacattgaaaaaattatgatactaaggctaccagaaattacaaaaattgcatatttaattttcaaaaattcaacaaataaaatagctttaataggttctggaatatcattaagtttagtaatgatcccattaattattgtttactacatgtctagcaacatcatgacttctactattaataaatatattgaaagtgaaggattttcaatgcaaatagaatacaacgaaacaaatagaacccattatttaaaagacagattaagcttattgaaaaaaaaacataattataaggatctaaattattttttcgagaaaagaacttatggaattattggaaacaataaaaaacaaggtgtattaataagagcaatagaaaataaattcatattagaaaacaaatcaataaaattaataaaaggtactaaaaacttaaaaaaggattctatactcatttcaaatcaaatcaaaaataaacttaatttaaatcttaatgaaaaaattgatattttgattccaaatacaaaaaatgataaaataatgcccagaataaaaaaatttaatatctcaggaataattgaaaccggattaaaagatattgataataatttggtattgatttcttttgaaaacgaaaatttaatgtcaaaaaaattttcaaaaagtataattggacttaaaacaaattccaattccataaaaaataatgagatcttaaaacagaatttagaaaccgaatttcaagaattccaaataaaaacattctatgaactttactcaaataaatacaataatctggatataagtaaaaaacttttaatattcattatggctttgattataatatttgcaagcatcaatatatcttcgtccctttcaatgcttatttttgaaaataaaaagaaaattgcaatactaaaatcaattggaatgaataatttaaatataaaaataatatttcttttgatatcgctcaccttaagcactatcttttgtggaattggaataataattggaaattatttaacacttaaaatatcttatttaataaactttattgacaatattttaaacttttttttaaaaatatttggagaagaaaattctgaaatattaaactcagaatattacgtatctgaatttcaaatacatttaagcctaagctttagcttaacacttcttggtctttatatgttaataaacattttaactacactgattccgcttaacattgtctcaaatctaaaagaaaaagaaatcttaagatagcttaaaactctatttaatcatcacattataaattttaatagaagaaaaatccttttcaattgtaggataaatctcatttggaaaaatcgtactaattgtaaaactctgcttggatttagactttaaaaaagaattggcagaagaaattaatttgcgtctcaaagacctaatgattctaccttccttatcaatataaccaatttcaatctccaaatttttaacaacatcttttgaagaattgaaaacttctataacagtatttgccttgcaaatcccaaaagacttttgaaaataatttccaatatatttaaattttaatataaaagaatctgagtcaagatttacaccaattttatcatcaacattctcaaaaaaatcaatgtcaatgatatctaatactattcttttaggattaacatcaatagctcttggtatgcttgatataacatcaattggaatataaacatctttaccccattttgcagaaaaatcactttctttagaaaaaatctgattaaacacagatttgccaagatcatcgtaaactgtaactctgtaggaaatctttttaacagggtgcattgttgagataacccccgctttaagctgatacaaatgcgcatcttcaaataccaaaactttagcatcctctatttctatgtaatagaaatctttgggacttgaaataagattaacagcttcaactactaaatccgtagccatagtaataggaggaaggccttgcgatgtaaaagagggagcaaatttttcttttaaagccattgcaccattcccattcatactcatgaaaccctgaaaagatctgtaagtaatcaaagaaatacaaaatatcaagatagagcttatggttaatattaacattctgttcttggatttcttaaattcataatagtcgattaaatctaaatcatctcttattccaaattcttttgcttgtaaagttacatggatcattttttttttagattctttagtatttaccttatcagcaacttctttaaaaagaaaaaaaaataaactaaacattgacttgtcgtgaagagaataaaaatagatagactcaagctctctaaaagcaatatctatcttgcctatatcaacaaatcttttggctctcgcataagatcttctaaagtgaagtcccatattttcaatgtcattatcagaaatatctgatacttcaataatatttttaatactctttttgcttaaaattttatttttatgcttcttaagcttcgataaataaatcttaattctatcttcagatgttttactactattcattatcttctaattcatcaactttttttaaaagccaatacgcaatatttctagcagtggtctttgtaatagaaatccctataaaagagttgattaatactatttttccctcttctccacttttaaattcttttgaagcctcttctaaaacaccttctttggtttttgtgtaagcaatctcctcagaaatctctgtggattcaaaaacaagatcacaaaaaatttctcctgtattagttacattcccataaatattattaacaggaactaatttataatcttcggctttttcaaacctataaattacttctttcatataaacgagtatatcataatcaaaaaacatagccaataaacaaaatttatacaaaaataaatttcaattttaaaaaaaaatgattattaattaataattattttaaactttttttgtgaaataaaaaataatgatataataattaaaagctaaaaattaaaacaaaggaatttataagaataatggatttcaaacaaataaaaagcaatgtcgaaaaggttaaatttttaagaaaagattttcctattttaaataaaaaatttgacaataagtatataatttactttgataatgcagcaacctctcaaaagcccaaaaacgtaatttattctaacgttgaatattatgaaaattacaacgcaaatgtacacagaagcggtcataaatttgcaattcaatcgagcataaaaatagaaaaaacaagagaacttgtaaaaaatttcattaatgcagaatctgcaaaaaatataatattcacctctggaactactgatggaattaataccattgcaagttcatttttttattcaaaatactttaaaaaaaaagatgaaattattcttacaactcttgaacataacagcaatttactgccttgggtaaatcttgcaaatttagctaatttaaaaattaaattagctaaattcaatgaaatgggaattattacccctgaagaaattgaaaaacttattacagaaaaaacaaagctcatcagtatttcaggaataaataataccctaggaaccattaatgatttggaatctattggaaaaatcgcaaaaaaatacaatatatgtctctttgtagatgctgcacaaatggcacctcatataaaaatagatgttaaaaaaattggctgtgattttttggtattttctggacataaaatgcttgctccaacaggaataggaattttatatatttcaaataatatggctgaaaaacttcacagctcaaaattggggggaaatactgtagaagaaatatttatagaaaatgaaaaaattaaatttaaagcatctgattctcctaataaatttgaatcgggaaccccaaatattgcaggaattattggacttgaagaggcaataaaatatattgacaatatttctatggattttattttagagcatgataaacagttaatcgaatatggggtaaaaaaattacaagagcttgatgaagttgaatttatactaaatacaaatcttaaaagaaattcaataatatcatttacagtaaaaaatatccactctcacgatattgaaacatatctagatacaatgggaatagcaaccagagccggaagaacttgttcctatgtggcatttttcccagaaaatttaaataaagaccatcttttaagaattagcttttatttttataatacacaagaagaaattgataatttcatattgggattaaaaaaggtaataaaagagctttcataaaaatttataaaataaagatcttaacaaagttaatcaaaaattgtatttttgattaactttaatttcaggattaataagaattgttttaatttttaaaaatataaaaacaatttcaactgtaatactatatttttaaagttttttatttaaaaatctttatattatcttttattattgatttaataaatcaaagaaaataaaattaaattatgctcactgaaaaaactaaaaaagaattaataagactaagtaaagtaaataattacataataaaagtagaaacaaaccagaatttcaaacatcaatctaaatgtggagaccaaattttattccaaataatagaaacaaataatgggaaatttaatttaaaacatcatgcatctggatgcatagttttacttgcaagcgcaaacgctttaaataaattgtgcaataacaaagcaaagtccgaaatcctaaatttagtgcaaaaagtgataaacagtaattttgcaaatctagatgaaattgacgtaagtttaaaaatttttaacgtatttacaaatacaaatagaaaagactgctttttactgccatacaaatcattaaaagatagtttggaaagctataagcctttaaggagaactatcagatgaaaatctattcacactcatcaatcggatatgaaggagaactaattgagattgaaatagacattaaaaaaggaatttctggaattgatatcgtaggacttgctgggagtgaaattaaagaatcaagagaaagagtaaaatcagctatcaagaattcaaattttcattttcccaaaaatagaatattaataaatcttgcaccagctggaattaaaaagcttggaacagcttttgacctttcgatcgctattagtattattaaaatccaagaaagcaaagatgataaaaatttagaaatcttaatattaggagaattgcaattagatggcaaaataagatcgataaaagcggttttaccggccattgcacttgccaaagaaaaggaaataaaatttgcaatagttccctttgaaaatttagaagaagctagtttaatagatggtttgaatatttggggtgttaaagacttaaaagaaactataaaaataatagaacaattaaacagcaatatactccccccaagaacaaatactaaaccccaatcaataattgaaaaagattatattatagattatgactttaaaaacataaaaggacaacaaagagcaaaaagagcaattgaaatagcaattgccggtgggcataacatcatgctatttggtccacctggaagcggaaaaacacttagtattaaatgcgcccaatctattcttcctccacttacaaacaaagagcttatagaaacaaacagaatatggtcaatatctgggaaattaatagacaggaaaataataaaacaaagaccttttagaaatccccaccacactgctagcaaagaaggaataatcggtgggggtcccaatcctttacctggggaagtgtctcttgcccacaacggaatattatttttagatgaagctttggaatttaaaaaatctatcctacaatctttacgcgaacctattgaagacaaatcaatttcaatctcaagagcaagttctaaattattcaaataccccgccaacttccaattaatgcttgcaatgaatctttgtccttgtggaaatcttggaaaaaaaaatacagattgtttttgctcacaacaagaaatttcaaattattggaaaaaacttggagccgcaatgcttgatagaattgatattagagtcccaacaagagcaattaataatgaaaaattactcagcgaaacaagcgaaagttcaagtgaaataaaacaaagaataataaaagcaagaaatattcaaaatataagatacgaaaattttgcaaacataaataaaaattctgatcttaattccgatcacattgaaaaattttgcgaattaagtgcaatcttaaaaaatgatttgatttacattttaaataaactcaacatatcttcaagagcaacacattcaatactaaaaattgcaagaacaatctccgatttaaaggaagaaaaaaatatttcaagagaagcattgcttgaagcaattgaacacagaaaaaacggagaaaatatgcttgaaaaatgaaaacccccaaaatatttggggtcttaatactaaaattccattttatcaatatagcttttaagctgattagcagaactattaaacttatcaagctctttagggcttatcttaaagtttaaaacttctttgactccttccttacaaactatagcaggcgctccaatataaatatctttaatcaatcccccatactggccattaatataagaagatattggcagaataacattctgatctccaattattgcatttacaatattcttaataccaagtccaatagcataataggttgccccctttaacttaataacttcataagcagcattcacaacctttttatgaatttcatcaagctccaactcagttattttgccttcagcaagatattctgacaaaggcttcattgctatttttgtttcatcccacgtagcaaaagaactgtcacygtgctcacccataatatatgaatgtatattttgagtgttcacattaaaatgatcacttaaaaaatatctaagtcttgaagtatcaagaatagtcccagtaccaataaccttatgaataggaaatttggaatatttcattgtaacataagtcataatgtctacaggattgcttgcaacaacaaaaataccatcaaaaccgctagatacaacattagttataatatctttaaaaattttagaatttttatcaaccaaatcaagtcttgtctcaccaggcttttgattaagtcctgctgtaattacaacaatatctgcattagcacaatctttgtaagtcccaaacaatacattaatattcttctttaaaaacatttggccatgattaaggtccatgacctccccttttgctttattttcattaacatcaataattacaagttcatgtacaagtgaattgtctattgttaaagcatacgcaaagcttgaaccaaccccaccagctccaataagaacaactttattagacttaagcataattactccattaaattaaaactatatacaaaactaattttaaataagtaatgataaaaatattctatcgcatttctaagggctttgccaatcacatacctttaaaaattaaaaacaaatttaattatcattggattttagaaccgcaagaaaagcgctttgtggaatctcaacatttcccaccatcttcattcgctttttaccttctttctgcttttccaaaagttttctcttacgagtaatatcaccaccataacacttggcagtaacatcttttctaacaggagagattgtctctcgagcaataacattagagccaatagcaccttgaatggctattctaaattgttgccttgctatttcatctttcaactttttacaaatcccaatagccttagttctggcgctatctttaaaaaccaactgggagagtgcatcaactctatccccattaactaatatatctaatcttaccaaatctgtatattcataatctaaaagctcataatcaaaagaagcatatccacggctcacagatttaattttatcataaaaatcaaaaaggatttcagaaagaggcattttataaataagttcaacacgcttagtatcaagataaattaagttcgtctgaactcctcttttcaataaacacacactcataatattgcccaaaaattctgtaggaacaataatattagccttaatataaggttcaagaacgctttcaatagcttcatttccgggaaattgctcaggagtttcaataaaataagattctccctttttaggaattattttgtatctaacagaaggagaagtcaatatcacgtttaaattaaattcacgctcaatgcgttcttgaataacttctaaatgcaaaagaccaagaaatccacacttaaaaccatgcccaagagcagatgatgaatctttttcaaatgttaacgatgcatcattaagttttaatctatccattgcctttaaaagatcatcatattgattagcatcaacaggataaactgaagagaatactacaggcttaacttctttaaatccctcaagaggagataatgcgggaaaatcacaaagtgttactgtatctccaattttcacatctgatatattttttattcctgcaataaaatatccaacatctcctgcttctaaggtatcttttctttcaagtgatattttaaaaattccgatttcttcaattaaatgctcgctattagtatgcattaacctaatcttatcgcccattttgatttgtccttcgaaaatcctaaagtgaacaacaactcctctataagaatcataatgagaatcaaaaattaatgctcttaatggatccttaatacttcccctaggagatggcacatacttacaaatagcttcaagcaaatcatcaattcctattccattcttagcagaaatcgaaatagcaatttcttcatttaatcctaaatcattttttatttgcttttttacaaaatcaacattagcatttggaagatctatcttattaataacgggaataatttctaaatcatgctcaaaagccatataaaaattagaaactgtttgagcttgtattccttgacttgcatcaattaataaaagagcaccctcacaagatgaaattgcccttgagacttcataagaaaaatcaacatggcctggagtatctacaaaatttaactcataaaaatcaccatcattacttttataagtaattgttactgcctgacttttaattgtaattcctctttctcgctcaatatccatactgtcaagcatttgacttttaaaatcacgatcagatattattttagctttttgaataaatcgatcagctaatgtagatttaccatgatcaatgtgtgcaataatgcaaaagtttttcttacgaatactaatactacttcccccctgaactacaagtcaaaatttaaaaatttaatttttttttaaatatacagaatttttaatttgacttcttgatttagcaatataaggagaaaaccttggcgcaagatctactactaatttccaagtatctattgctctaaatttataattgccattagaatatgcataagtagcagcagcaacattataaactatttcccaaaaatctgtagattcaaaagcattttttattgccttatacttattaattttttgaacaaaagaccttaaatttttaaactgatacacaggttcataataacaaacataatcatacattcttgttaaaattcctactgcagctataagtccatgagtaattgaaagctcataagcttttaagtgcaaataaacttttgacaataattgatgagtatcaataacattgtagtttttaaatctgtaaagattaaaagtaaaatcaataccaaaagctcctcttacttgttttaaataagaagttaaataaaatgaagcattaagttcattatttgacatactgttttcgccttgagaataatcatgataactataataatcttttttagttgaaaacttatttaatatgtcattcaaataatcaatagtatcaacataattattctcaagttcagccattttagctaaagaaaaaagtatttttttttcaaaagattcatctagcaaataatatctgtcttcaaaagacttataaaggtttaatttttcaagaatagcattgccagacataccataagctactgacaaataataactagcctcaggataaacgccttttctaagcaaagcttcctgcaaataattaatagcatgtgtaagattagacttactaaattcagatttagaataaagaaattgcctgcctttttcaagtaaaatccaatacggaaaatttttattacttgaagaatacaaagaaatagaaaaaggcaaagcaaaaaaaaataaaaccgcacttctcataataataaatatattaaattaactcataaattacgagaaaatttaatattaaaagaaataataaatcaaaattaaacaaacttaaatatcattaagaataccattacaaaaagagcaacggattctattaatcctaaaactaatagatatgtggcaaatcctttcccagtctcagaaaatgcatcgcaagcacctgctgccgctttaccttgagcaaatccagaaacagcaatagcaaacccaccaccaataccagctccaagcaacaaccatggatttgtctgcatcattacctcatataatgtgttcatcaaaatatatccatatattatttgagtcaatggtgctgaaacaaaaactatcaataaaaatggtgctggctttccttgcatatagcatctcttccatgctccaatagcagcactacctgccgcccccatgcccaacgcagaacctattgctgagattgttaaagctgaattaacccctattaaacctatatccataaatactcctttttatttattttttcatttttttaaaaggcctataagcacatccactccattcttgccccaaatggtttgaaaattcaagcatattaagccttaccccatgaacaattactgaaagcaaagataacattatatttaaaacatgcccaaaaagtataacaataattccagctactataagaccaatattagaagattttaacaaaggtattgacatagtattaaaacttgctgatattgaaagccccgcaagcccaactgcaaaaagtctaatataagatattatatctgcaaaccccgacacagtggttaaaaactgctctataatacccccaaaacttttcaatatacacttgaaaaaatttgaaccatcttgcttgccaaaaacaaatacaagtgcaacgccaaaatatattacattataaacaacattatacatgggaaatctagattgacttagtattaaattcaaaacaagataataaagtccaactatacacataagccaaccaatctgtgcaattgaatgaatatggggcttttcttttacttgtctgaaaaaattccaaacatgcgccaatgaaatttgcaaaacccctattgaaaaacagataaagataatattttgtacactatttttctctgtcaaataactaactttaaatgaatttaaaataggaaacatttcaagaattaaaggactaccaaaccaagtcccagtcatagcaccataaagtatcgatgatacactaagataaaatattaacccatgaaatggcgttaagggcttgcctttaagaagaaaactcaaactaagcaaaattcctatcaaaaaaaatatcactccataagcagcatcacctattatcataccaaaaaacacaaagaaaaataacataaagataaaacttatatccctttctttgtacccaggaattgtctctaaaatattaaaaatgggtgcagctaaattggcaattccttttctttttatataagttggaataatatcattttcttcaggatctgcaaattgagctgcaaaacctgcttttaaaactgcgtttttaagagattcttgactttcagctggaacaaatcctgtaatatacgaaaaatcttcmaaatcagtttgcatatcagctaaaacttgctcaaactctacgatttgatcgtaattttttatctcatctcttaaaatatcaatatatttattaaaaagagaaatttgtgtcaatttttgatctaaaatctcatcaacaacctttaatttattattaatataatcaagatcaaaattaaatttaaactcatcagcaatttcaattttttgctcaaattcaccaacactcacaaaataagaagtgttttttacgtttttaatcaaaagcacattgacattagggtctcttaataaatttttatattcactcttttggattttaaaaaattgaatataaatgttagactcttttaattcgtcaatattctctaaagaaaaatttccccaaacagaaatcaaattcctttcatgtaataaagatcgtttaatatcttgaaattctttaatttcattgcccaaattgactatgctttttgcaatatctaaaaaatttccattagaagattttaaagctttaacacctccatcttctttaagcagggaaaaagcttgcattaaaattcgtctatcatcaatgcttttttttaaagaatctgaattcttattgcaagaattaatatgaactgctccaaaatctcttaaaatctctaatgactcttttttatattttgataaagttaaaagcaacacttttttcatttttacaatcataagctgttcctatttttttttatcaaactagatttagcaatcttacctcttacaacagccgcggtttgctgatctccaagatatatattaattttttttatattagccttagctgttggtatcataactttctcaaataaattaaccctctgagatgttattctaaactctcttaaaagcaaatcaatctgtttttttaaaattttaagttctacatcaatttgaatcacaactttaagaatctcaatccccttatctacccaataaggagtaaaaagtaaatcatgccttatgtcttcatattcaatagaatcgaatataggaattgcaactccagcaatatttaaagactttttgactactgtttttacttgaatccaactctcaaaaggaaatttttcgctaaaaagagaaatccaattagaaatattctccttaagtttttgttgctcaagatttttaattttgtaagaattctcaattttaacaatttccatataaagctgctgcttcttaagctgcaaagtaggcaaatatctcttaaacattttaagttcgtctttttgctttttaagatcatttttggttaatttaattttagacataatcaataagtctcttttttaggccaatatttttcaataagatctgtttttattcccgtttcttttgggctaaaacaactagcaagaatgctccaacctaaatctaaagcctcttctaaaggaatattaacagacaaatccatcatcttactttcaaacatattgctatacttgagcaatttttcatcccacttagtcatattaaatcccatagcctttttttctacagactcttttgaagatgcataaagcttgatcattgaatccattatagtcctgtgatcgtctctagttctactatttaccatttgcttaagtcttgaaagagacccaaaaggctctattctgccaccttttaaatagtattgaccttctgtaatgtatccagtattgtcaggaacaggatgagtaacatcgtcacccggcattgttgtaactgcaagtattgtaattgatcctgcgccttcaaagtcaatagccttctcataacgatatgcaagctgagaatacaaatccccgggataacctctattagaaggcacttgttccattgtaatagatatttctttcattgcatcagcaaaatttgtcatgtctgtgagaagcaccaaaacttttttgccctttagagcaaacttttcagcaacagaaagtgaaatatcaggaacagttaaagattcaacaacagaatcattagcagtatgaacaaaaaaaattgctctacttaaagcacctcccttttctaaagaatctttaaaagttaaataatcatcatgcttaagtcccattccgccaagaattattaaatcaacttctgcttgaagtgcaattcttataagaagctcattataaggctcaccagaaacagaaaaaattggcaatttttgagattcaacaagagtattaaaaacatctatcattggaagccctgtccttatcatatttctaggaacaatgcgttttgtaggatttgcagaaggcccaccaatttcaatcaaattatcatcaagagaagggcccccatctctaggattcccagaaccatcaaaaattctgcccaacaaattgtcagaaaatgaaacctgcattgaatgccctaaaaactttatctcgtctgacgtggaaacacctcttgtaccaccataaacctgaagagaaactttttctcgatcaagtttaattacttcggctagagaacttgtatcttttgcttttacaatagcaagctcaccatacttaataccttgagctgtaacagttattacattgcctgctatagactctattttactatagactcttttcatatatatatttctccaaaccccctaaattacctttttaaaatttatcaattcacccaaagcatgctccaatttattaaacttatgatccttaaaagaagaaagattcatgtctaaaagattttgccttaactcatttataaaatctcttgcttgaagtttatcagaaaactcaaagttagttttaagaatgttataaactatatcaaacatataattttgacgctctgaactaacagcagcatcaatagaatcaaatgaattttgctgcaaatagcacgaatcaagtagctcggattttaaataaattaaaaaatcatcgttacttatgccttcttctccaacaactttcatcatttgattaatttcattacctttcaccaaaaaagatcttgcatattcagtctttttttgatcaataacgcctttatatttactccaagattcaagaggactaatagctggaaatttcctagcatcagacctttctcttgtaagcccgtgaaatgctcctacaacttttaaagttgcttgagtaactggctcttcaaaattaccaccagcaggacttacagagccaccaactgttacagatccaatatccccattattaagaactacaatacctgccctttcataaaaggaagcaataacagactcaagatatgccggaaaagcctcctcgccaggaatttcctcaaggcgtccagacatttctctcattgcttgagcccatcttgaagttgaatctgccaaaagaagaatatcaaggcccatttgcctgtaatactcaccaatagtaatagcagtataaacagaagcttctctagctgcaactggcattgaagatgtattacaaataatacaagtcctgtccattaaagatttgccggtttttggatccattaattcgggaaattctttaagagtttctaccacttctcctgctcgctcaccacaagctgcaataatcactacatcaacatcagcatttcgacttgtaacctgctgaagaaccgtttttcctgctccaaaaggacccggaatgcaaaaagttccacctttggcaactgggaaaaatgtatctataattctagtttgagtcaacataggttcactaggaataaggcgttccttataattagtaataggaactttaacaggccaatgaaaagacattgtaatattatgcctcataccagaatcatcttcaattacagcaatttgctcatcaatcgaatagtcgccatcacttacaatctccacaattttataagaatcccttttataaaatggaatcattatttgatggtgaacagttccctcaattacaaaacctaaaaaatctcctgcaataacgatatctccaactttggaggtttttttaaaattccactttttatctttattcaagggccttaaatatactcccctttctaaaaaaaatccacattgaatagccaattcaggcaaaggattttgaagcccatcatatacttgagttaaaagccctggtccgagttcaactgttaaaagtttgtctgtaaattcaactaggtctccaacagatatcccttttgtcaattcaaaaacctgtgcatcaacttcattgcccctaatacgaattacttctgcttttaaattcctaccagcagtctttacaaataaaacttcattcatagaaactgaaccttctacctcaatagtaactaagtttccattaactccaacgacttttccttttgtattcatttaaattccttttctaaactttttcattagttttatcaattaaatttttacaaatattgtcaaaattttgaatacccaatttttctttaaacaaattatgccttaaaaataaccttaactttaaaaagtaaattattaatttctcaaaatcaaattcatgcccaacctcaagatcagttaaaaattgccacttaagaaggtcaaaacttaattctatttcaaaaggattttctttcaagcagatgtttttcaaaatactaagatagtaacttgaaaaataagtagactctaaataaaaatccttagacaatcccaatttttctgcccttaaagctgcaagtgtatatcttattgtatcttcaaaattaagaaaaaggtcaataactcttgacttgcccctatctatcttaaattctagcaactcttttaaaaaattgaagtcctttttacttaaagaaatttcgacattatttaaaaaatctgaaacactataatttttcaaagattttaaatcaatataaggcaaagaagataaaacataataatatgaatctaacacaaaagtctcctagaccacttttataacttccttaaatcttggattaagataatcaaaaagaatgtctgcaatagtttcagctgaaaaatcataatgcaaaccaatattctttttttgaatcttaaaacctttgcttatgcccctgaaaggcctaagctccatcccttccttaagcttattgccaagttttagtcttaatatctgctctaaactagaaaaatcagattcatttaattgaataactaatttttctcccttagcccatgaatctgttattttaattataagctctgctaaaaaattattatcacttaaaacttccgtcacattatcttttaaagcattttcaaaaagagatttaagattcttttcaacgccaataattaaatctcttattgcctgacgagaagcttcaagggcatggcatttataatcattagcttctttttctgattttgcctttaatactctagcagcttcttctgctctagcaactatttcctctgcctctcttttagccttcaaaataatatcattagatgctctctcagcttcttcaagcccatcttttttaattttatttatcagatcctttacttcaaattgcatcaaaactccttatcatataagataaaaataataacctaacacttattagcaaacaaaactttaaaaaagcataaaataaatttttaatatcaaaaattttacaatattaaaaaacatatcaagttggcacaataatacttctttaaagaatatacttattctcaactattagaaataatacaaccattaaaaaaatggtccaataattttataaacattgccatcaagcactatatcaagatttttgcttggaaatttatttttaagtccttctctaaagatttcaataccccttttatttatcttatcccaaaattcatcatcaacaaaatttaaagttaatatctcaataataatcaaataacctcttccaaacctagatccatagcctgacgtaaaagttgttgtaacactaaaaagaccatctaaaagaccatttgcagccttacccctaaagggcctgttgggatgaatatcataagaattgccaaattcattctcaagcacaaaatcaacatcaaggcaaatgtgaaacaatacattttcaaattcattaaatttcgatatattcacttaaattaaatctcaactatggtttttccagaccctccatcactagggtgagcaaaataatattttctaataaacttcaattcttttaataaattgtgaacttctctcataagatggccctccccttttccatgaatgatctcaaatttattaataccatttaatataatattatctattttcttattcaaaaagtctagagcatcaacagacctcatacccctaatatcaatggtaaagcttaataaattttccttattataatcaattgaaaagttaaaattttttccattctcttttttttctttaaagttttccaaagatatctctgagctagaaacactaacattaaaagcacctacattaacggtgatcttcttttttgagatcccgactatttttccttttgcattagaattaactattctaaccttgtctcctattttaaaatctgcaactacatttctcttattgttaagagaattcactttatttgtcttgaggtctacatttttttccaaatctgatataaaagctttattctttgcaacattaatattgccctcttttatttctctaaccaaattttctaaaacttttcttgaattttttaaaaattcattctgctcatttaaaagctttgtctcaatatttttttcccttaataaaagatcttgataaaaattttctagctctttttcttgcaattctatttggattaatttcttatccatactttctttaattaaaagcaaatctttttctttttctattaatttttctaaaatttcattaatttctgttttttgagatgaataaatttcattagcacgaattactatgctcctgtcaatcaaagccttgctagcaacattaaacgcataactttcaccaggaatggaaaaaattaaattataattgggctgcattgtctctaaatccatccgcatagaagcattaacaacaccttcatgggtatatgcaaaatatttaagagcattataatgagttgatattaaaacataagaattaatattgatcaaatattcaagaattgaaatagcaagcgcctgaccttgatcaatgtctgttcctgagcaaaattcatcaaatattacaaggctatcttttgtagtatgttttaaaatataagaaatattgctcatatggcttgaaaaagttgaaagagaattagaaattgactgctcatcaccaatgtcaataaaaatgttatcaaaaattttaaaagtgctagactcaccaacaacaatagggatcccaaattgaaacattgcactaagtagtccaattgtctttaaagttaccgtttttccaccagcattaggaccagtaataattacaacacgattctcagcaggagtaaaagttattgcctttgaatcctttaacaaaggatggtgtgcatcaaaaatatttaatacatttgaaatctcgggaaatacccctttagttttgattccataaatcgctcgagcttttaaagaatcataatacaaaaaattattataaaggttatctaaaagaacaatgttgctatgaactttagcagaaagatttcgtaaaatttttaaaattattctttctttttctaagctcaaataatttaacctgttgttagcatttacaatatcgtttggctcaatataaaatgtttcacctgatgacgaaatagaaataatattacccttaattttgcctttaaaattagacttaagagcaagggtatatttattcgatttataacaaacaaaattagaagtcaaatattctgcgttcaaactaattattttttttatctgattttcaactcgtctatttaaatttttaatttcaaattcaatcgaatcatattcttttacaacaccacttttcaattcaagagcatcaacatctatatgttctttcaattcattaagcaaattttttagctctgggtttaaaaataataaatcagataaaatctgaacattaagatgcttgatatcactatttttatgcaaaaataaatttattcttaaaacctcatctaaaaacactataatatctctcaaattttcaatagaaactcttgaattttcttttaataataatgaaatgggatattttaaactatttataaaagaatttggatatcctttgcaactttcaaaaagcattctaatcagacttacaaaggagaatattttctctaaactttcttttgtttttaatattttttgattacttagtaaattaacagtatccggattagaaacgtatttagatactaaagataaaatttcataaaagtcaatattttttaaatatttatcttgttcatcttgcataatttttataatttttaagctctgacaaaatctttaaatagctttcgtatctaagtttagaaattccattatccaaagaacttgtaacagaacaataaggttcgctaacatgcaaacaggatttatatttacaaaaactagcaaaattttcaaactctttaaaataatacttaagattctcaaagggtaatgtttcaattccaaactcctttattcctggagtatcaactattattccgctatcagaatgaaatgatattgaataaacggtagtatgttttcccctagaatacttatgtgaaatttcatttaccgattgagaagctcttgaatcaatcaaatttatcaaagaagatttaccaacgccagactggccaataaaagaagttcttgaatttttcaaaacctcttttacttctttaatgccctcataagttttaacagaagtttttaaaaccttgtatcctagattttcataaatttcagaaaattcttgtgccttttggcttattcctttgtcaattttattaatcacaataataggaacaatattttgttcttctgcaacaataagaactctgtcaataaagaaatttttcatctcaggaaaattagcagaacttacaatcaaaacattatcaatattagaaacaattgtctgtctaagatctgctttcttattgtaacgccaaagaatatttttcctgcttaatcgcttatcaatatacactttgcgagaactataaatatatcctaagactatatcccccggaactaaaggactgtactccttgcaacctgtttctaataccttacccttaaaaattccttcataaattaacttactgttaagctctaaaatagaatatatattattaactccccaaataacttcaaattcaagataattcaaactatcattcccttaaagcgaagattatattttttgcaaaaattttgataaaaagtcaaatttttattttcggtcaaataaaactcatcatctacaaaatcaaaatcattcttataataattacctttgtgttcagaaaaattcattgatctaataagattttttaccactaattcacgattctcataaacaggaatttttaaaaaatcttctatcattaccttaagatgcaaataatgcgtgcatccaagaaaaacaatttctctaccagtatttacaacttcaaattttaaagcttctaaacatctaagagcatattttttgtaattctctccatattcaacaaaattaacaagctctccagcagcttttacaatcaaatcattatgtatatttacttgatccttaacaaatttgctttcaagagtagtatttgttgcaatcaaaagaactctttttaaaacaagatctgaaactgaacttacatctggcaaagtatagactactggaaaaacaaaatttaatttattgtatacactaacagaaattgtattacaagccaaaactaatgcaccaatattatagatttttttaagcttctcaatcaaaaacaaaactgcttctagaagatattcaggacttttttctccataagggaaatttttattatcggcaacataaacatattggcatccccctattctacttttaatatatttaaaataagaaagccctcctattcctgaatcaaaaataattattacttctttgaaatttttcattacaaaataataatcacccctaaaaagtaaagtataaatattaacaaagttaatatcaagaattaaaataataaaaattgttaaatgttttttttaaaaaaagttttaagctataataaaattgatttaacaatattaataagttaagtatttaggatgataaataaaatgtttgcaagcattaaagatattttaaaaaacccaattttaaacagcaatgttacaataaacggctggattagaaccaaaagaagtaatggcaaaattggatttatagaaattaatgatggttcaacgcttaaaggaattcaagctgtaataaacgaagaagaaaatcaatttagtgaaaaagatctaaaaaaattaacaacaggaacaagtatatcgttaacgggcctattagtagaaagtcctgcaaaagggcaaaattatgaaataaaaacacatagttttaatgtaatcggggaaacagacccagaaacttacccattgcaaaagaaaagacattcttttgaatttttaagagaaataccccatttaagaatacgaaccaacacatttggagctattgctagggtaagaaacaaaatttcatacaaaattcatgaatatttccaaaaaaatggttttttttatattaatacaccaataattacatcaaatgatggggaaggtgctggagaaatgtttagggtttccacactaaaatttaataaactaaacaatgcacttagcaatattgattttaaagacgatttttttggaaaagaagcttttctctctgtcactggtcaattgcatggggaagcatatgcaatggctttatctaaaatatatacattcggaccaacatttagagcagaaaattctaacaccacacgccacgcttcagaattttggatgatagaaccagaaatggctttttataagcttaacgacaatattgccctagcagaagatctcttgaaatatcttttaagttcaattttaaacgaatgctcacaagatatggattttttagaaaattacattgaaaaaggtttaattaaaaaactagaaaatgtaataaattcaaattttgaggttattacctatactaaagcaattgaaattcttgaaaactcaaaaaaaaattttgaaataaaaccttactggggaatagatttgcaaacagatcacgaaagatacctaacagaagagacttttaaaaaaccggtagtggtcattgattatccaaaaaatttcaaagcattttacatgaaagcaaataaagacaataaaactgttaaaggaatggacatacttgttccaaaaattggagagattatagggggaagcgaaagagaagatgaccttcaaaaattagaaaatagaataaaagaattaaacttaaacattgaacatctaaactggtatcttgatctaagaagatttggctcggctcctcattctggctttggacttggacttgaaagattggtgcaatactcaacaggaatatctaatataagagattcaataccattcccaaggactcctaaaaatctttatttttaatcaaaagaaaggaaacaaaaagatgaaattaccaaaactttacaaattaatactactctttctttttacaacaagattgttttcagtaaaagatgaaaaatcagacaataaattggaattattttcaaacgtagaaacaaaaatcaaaaaaaattctaaaaattacgactcaaattcaaacagcaaaaagatcaaaaaagaatcaattttaaaaagagatacaaacagcgaaaaaaatataaattccaatatatacatacaaaaatcaaaaaaaattaattaccccaacagaaatttaggcaataatatcaatcaaaaaactgcaaatgatgtaaattttacaaaaactagttatgttaaagtttatcccaactataaagacgataactttcaagaaattaaaaatgctaataaatttccagctaaaaccgaaaaaactcacatgctaatcggcccaatattaaaagataatctaggaataataattaaaatgctaaaaacaaagggatacactttaatagaatacatagaggacaataattaagatttattttttgccaaaaattttaaaatctcattaagctcatcatctatgtatttgaaactattcttatattcactttcatttaatcctgtcagctcatgatttccataatgaatccaagtatttaattcttcttggttagaatatttattaacataataatcaggaatataatctacaaatccatgatccttataatcgtaaactgctattttaacattttcactctctatgcctttttttaaaacttcatttctcaaataaacaatagtacgacctgtatcaaaaatgtcatcaacaaataaaactttatcgcctgcccttaaatattttggatcataagtccagccatctatcattatctttttttgctcattaaaaatatcataagatctagcaacaacagcagcatataaaagaggtttatctacttttacaaatttaaaaaattcgctaataatattgccaagataggcccctcctctcagagagacatacataatatctggaataaatccatctttataaattttataagcaagcttaaatccattaattcttatctcttcataagaaacatatttcttcataattcaaacttattccttttattctttcctaataacaataaaatttatttaatcaaaatattttaacttgcaaattaacacacaaatatttgcataaaataaaatcattacaatctaaaagctttacaattatatgtaaaacaaaaaagggctaagatcaactcttaacccaaaactaaaatttactaaaatgtaattttaaaagaatcgtttcctctcaaaattttataagtattttttccaacctcaagagcatcataaaattctcttaaattagaaacactttttgaatttacagaaagaattacatctcctgatttcattttaatatttgatgctaaatttttatcaatataatcaacaacaacacctttaatccaatttcttaaattaagctgagctttaatatcctcaaccaatggatacacaacaaagcctggaagcatctttgaagaagaaagctctttatccttaggtctaacagcaagaacaatctcaatattttttttgacattgcctcttaagatttctacatttactttctcaccagcataaaaatcactaatatatgatgtaacatcttgaaaaacgctcatggaaaccccattaaccttcataataatatcccctgccctaagccctgatttaacagcgggtgaacccggataaagagaagcaataattgcagctgaaacatcattactttcaacccctaagctttttagcacctcagaatctcttgtctttagcggataaaaagaaattccaagccaagccgattcaatttttttacctttaaggaaaaaatctacagtgcttttaatattgttaacaggaattgcaaaacccaacccaatatttccgccagaatttgaagctatccaagcattaattccaataacctcgccctttatatttacaagaggaccacctgaattacccctgttgattgcagcatcggtttgaataaacagattccttgattgcaaattaggatttgcagaacgttgcaatccacttacaatacctgctgtaactgtaaaactaaattgaaaagggctgcccactgccataacccaatcacctatttcaagcttatcactatctccaagatcagctactttaatagttgcgtcatcactttcaaagctaataagggcaatatcctttttttcatctttgccaattaacttagccttgtgcttttttttatcataagatacaacttcaagttcagttgccttatctaccacatgactattcgtaaccacataaaataatgattttttttgagaatctctaccaattattactccagaccccgcccaattgctttttctctcagaatcaaattctggcatatcaaaaaagaaaaatggaataggaaaactctgcttgattacccctgttgcatgaacttccacagatgatggtaaaattttcttggaaacctctctaaaagaatcttgtaaggctcgtacggtattgtccttttcttctgcaaaaacaatgttgcttctattagaagctaaataatgcatcccaataaaaaatccaatactcaaagccaaaaaactaagaagaaatccagaaaaaaactttttttccacttttataacctccacataattactcaattttataaataatatttaaatatttgattaatttaaaatttaaacttcacttaaaattaaaggcaatccatcaacaacagcaacagtatgttcaaaatgtgcagaataactaagatcagatgcaaaaacagtccaaccatcactttttattgaaaccttgtgcccccttaagtttaccataggctcaatagccaaaaccataccctcttgaattctaatatttttaaaaaaaggagcataataatttggaacacttggttcttcgtgaagttcaaatccaacaccatggcctgtatattctctaactattccaaaaccaaacggctttatataatcttctattgcctttgatatatttaaaattctatttccaactttcatctcagcgatacccttgtaaagagaggcatttgtaacttctaaaagtttatcgatactagaatctacatttccaaccttaaaagtttttgccatatcgctataaaacccatcaagaataaccccacagtcaatactaacaatatccccatccgctaattttctttttccgggaatgccgtgaataacctcttcattaacagatgcgcaaatagtgcccttaaacccacgatatcccttaaaagcaggcttagctctatttttaataataaaatcataggctatcaaatcaagctccttggtgctaataccaggaacaatatttctctcaacttctaacaaagtaagcgctaacaaacttgctgaagcttttatttttttaatctcatctttagatttcaatcttagtttagtcaaaattcaaattcctttctctaagtgtatctatcatatttttataaagccttccttcatcggtttcgtaaaaagaataagaagccaaaatagactctttgcctttttccatttttcctaaataaagataattaattccttgttttaagtagatttttgatacaagctcacgctcatagggggtagtagaatctttatcgtaaaaactactaggcaataaagatattcctttattaaaatatctttccgcttcttcatagtctttttcagaaaagctcaaaactccaagattataataaattccaaacatatatttttgagatttattgtcaaaaattatcttttttgaactaataaaatctcttttaaggaaataataataaaatttataaaaatcataccaatcttgtttattttcagaaaaattataaattctgaaaaataaatccaagtcctttaaatctgaataaagtagcaaattccaagccaaaaattgagcaatactagaattatactcagtcttataaaataatcgccacaaataagatttttttgcctcatacttagaatttgcataatttaatgcaaaataaagtttaaaaaataacggatcttccttataattagctataatttcattagctttaaaataatttttaattccaaagtatatgtttgctaaataataatttattatcttattatctttaaatacctcattagccttatttaaataagaaattgctcttttataatcattctcactattagctatgagtgcaagatttaaataaacaagaacattgtaatcaggaaatcttgtataaagctttaaatattcattcttagcattcttaatatctccttttttaaaataagcatcggcaagcaaaaaaagtaaagtgggatcttcttcatttttaatggacttaagattggaaattgtataatctaaatcattaagattatatgaaatatatgcaagttcttttaaaaaacttttgtcttctttgattctaaaaagtatacgcttagcagaatctatgttttttttctctatatacaaaagcattgcatttattaaaaatgcattatttttaagatttaaacctatctcttcaaaaatacgagcatccttttctttatagattttatcaataaatttgttaaaatctaaaataccattatctgaacttaaatttttaataaaaacttcatcataaagaccttgatactcttcgctatttaaaagatattcatttgcaattctataagcatcttttaaaagcccaattttaagcttagaataaacttccaaagctcttaatttcaaattccccggcaaaactttaacaccaagatttactatttcccccataagatgataatcacctgtatttaaagcccaaagtttagctcttttagcaagggctagccatttaaattcagtattagcataatatgatgaaaatagcattgcttttttagcatcagcaaatttttttttatcaatataaaaatcaattcccataataagtttgctaaaatctttctcaccttttagaagatataaaatattgggatcgaaatagaaataaaagccacctaaaaaaactgataataagaataatgaaatgaacactaaagttttattttttttcaataccactctccatatttttaagcaaagcatcaagtataccatttataaacttataagagtttttactgccatatttcttggcaatcaaaattgcctcatcaattatagcacgttttgaattttcaaaattttggaacttcaaagaatagacgcccatcctaagtattgcaagatcaaccttatccatgcgttctaaagaccaattcaaagaaatatccctaatgaggctatcaatatgctctaaattatcaaaagtaccaattaccaaagaagagtaaaacgacttaatagactcattttctatgtctaaatctttatcttcaatattaaaaatatcaaaaatatcgtccattgcgctttgattaatatcaatgctataaatcttttgaaaagctaaaactctaacttcatgcattaaatccataataaaattatataaataaaaatatgttttattttagactagaatccaagatttgtatatttgcagacttgttaagcttaccatacatatcttgctgtacttgaacaacaatttgctgttgttgaacattaatcatgttatttcttattgcatctttgacaatcaaatctgcagtaggagacactttatcattcaaacctaaaaatctctgagcatatttttctgtaactttaacaatatgaaacccttcctttgaagcaataggcgaagatatatcacccttattaaaattaaaaacctctttcacaaaatcggctccaagaagattttgagcattttgatcacctcttgataaaaacccaagatcaccatttttagccttagaagattcgtcatttgaatattttcttacagcttcttcaaaagtaattttttttgatcttatttggcttaaaatattttttgcttgatctaaaacatctgatctttttttatctttagtagaaaaaaagatatgactaactcttgaaatatcgggatttacaaacttagttttattagcctcataatactcaacaatttctttctcactaggagttttaatttcagaaaacttaggctgagcttgctttaaaacaagcttttgagaagacagagatcttttcattgaagacaaaagctcgccccaatttgtaccttgtttttctatcatttgcttgatttgttcatcagtaaaattcacaagcccaaattgagttctaattgtttgcataacctcatcatctgagattttaattccttgctttgaagcctcttgactaaaaagaacatctgctattaaaacttgcagaacttgctttttctcagcatcagttaagtctctaccttgggtctttttaaatatatcaaccttagaatcaaaaccagttttagtaataatttcattcttatataaattaataatagcaacaggagtattttgagcaaaagagctaatccctacagttcccaatattacccaaaataaaaaactcttcataacataacctcttattaaagaatcacttacccactaatttaacaaaattttacatttaaatctagttaataaaacattttcatctatacaaaaaactagaaattccttgtccgccaccaatacaaacagatgctatcccttttgttttattcttcattttcatagagcgagaaagtgttaataaaattcttgaaccgctaacggcaaatggatgccccaaagcaatagcaccaccatttacattaataatatcgctagttatattgtattttttaaacaaggccttttcaatgcttaatgcttgagctgcaaatgcctcatttacctcaatcaaatctatttcgctaggatttaaacttaatttactaataatgccttcaatagccatataagctccaaaacccatataaagtggatcaagccccacgcttttaaatcctccaatataagctaatggacttaaccccaagctttttactctttcctcacttgctaaaattaaaaaacaagcaccatcatttaaacttgaagaatttccggcagttactgtgcctgattctttaaaaacaggattaagagatgctagcttatttaaagttaaattatctcttatttcctcatcacttgagatagttacgctagagttggtcttcttatcaaaaacagtcaggggataaatttcatcctcaaaatatccaagctctcttgcctttaatgcctttacatgagaattatatgcaaattcatcttgcatttctcttgttattctatatttttctgaaagattttcagccgtaagccccatagaaataaaattcagagaatctattaaggcgtctttttggattgaatcttcaattccaaaattaccaaatttaagaccgtcaaatctaatctttctaggtaataaataaggagaattggttaaatcttcaactcctccagctaaaacaatatcattgtctccaagggcaatagaattaaatgcaagctccaaggccttaagcccagaaccacaaactttattaacgctaaatgcaggcacagtatcgcctaagtcagactttaaagcaatttgtcttgcaatattttgaccaagtcccgcagatattacattaccaataataacctcatccactttgtataacttatttctttcaagcaaagctttaacaacttttgaagattcatcaataatatttaaacccttaaaagaacctccaaacttgaaattgggtgttctaagtccatcaataatagctaccttttttatcacaattactcctaaagtcttaataaacttattgaattatacaatacaatagatcatataaaaactaagtttatttaataaaaataaactatttaacctgaattatttaataaacaagctaaaatgttataattttaaaatgcggtttaaaaaaatatttttaataatatttataatttctaatttaaaagtttattcttataattatgcaatccaatataaaaatgaaggtattgacaaatattattttgaaatactaaatgatggattcggattttcattaagcgatttttttgatgacttgagaagtggttctcttatttttacctatgtttcaaaatacaattttataataaatttagaagcacacatgttaacctataggggttataaagactctccgaaatctttaattagtagaacagacttaattgaaataggcttcatgtactattttccaattttattgctaattaatggaaaaaattttggagaaatagacttgggaattggagttaaaaacttattatttggagactggggagggcatttaatgcaaagcataattcacctcattttaaatcaacaccgtccaattccaagtataaaaagctacgacagctacaattatagaggatttttaagctttgctctaaattactcttacatgaattttttaaatttagaaaattatatggacttatcttattttgcagattattttattaaaaacagtattggaattaccttaaaaaatgaaaatattggatttgatataaaactttattcccaaattcaaaatcaaatcaaaagcctcaaaacatattcaaaaacacaagaagcagaaacaggaattggaataaattatcaattttactctaaaaattttttcataaccaataatttaaacattaaaaatttttcaaccaaagaaaatttcttaagcgttgggggatttggaataatcattacacctgaagaatacaaaaaaatatcagaatcaaataatgaatttaatgttataagtaataatttttactttggatttgatattatgatcccattaaaaataagaaattcattattttataaaataaatgaaaacatcaaccattacttttcaatatcaacaaattattacactaattataatgaaactaatagctttacaaatcaattatcatcaggcatcatgtatgaatttttaccacaaaaaacattcaatccttacctaatttcgggattattttttgcctataatcaaaacaataaagatatcaaaagcatctcaagaccaataagaataaaaaacattcttcaagttggaattgaaaatgaattaggatttttgttcaaaatgctaaaataccgcaacactgagtatattttcaaaatatattcaaaagttaactatattcctatagcttataacttagatgaaaaaaaattagaaaaacattctattaactttaattatttaggaattggaatagtcgttaaataacaactaatactggtggtctttgttaacaaacttagtaatgtgtggcaaaaataatatatctgccctacctgtagggccatttctatgttttgctacaataaccttggtttctattggttctatctcagcagaagactcaaatttaaaatccttatccctatgaagtaaaattacaatgtcagcatcttgctccaatgctcctgattcccttagactagcaagattaggctcacgcccttccgtatctcttgtaagctgagataatgcgacaataggaatctcaagctctctagcaagctctttgagagatttactaatcgaagcaacttgttcatgccttggaagattttttgtttcaaaagaaatcagactgatataatcaacaaatattatatctataccataaaatcgcttaagttttctagcttgagttgccaaagttagcaaactaatattgggagtatcttcaatataaagctcagaatcactaatttcatttataatatcatttaatgattttatctcttgtccagataaaatgctattttgaactttaaagctatcaatacaagactgagaagatattattctttttattaaagcatctgctgtcatttcaagggaaaaaaatcctacttttttcttttcttcttttcttaatgctatataagaagcaatatttaaagcaaatgccgttttaccgatgctaggacgagcaccaactataataaaatcactatttctaaatcccccaataagagagtcgacctttctaaagccacttggaatgccaaagtttgcttcttttttcttcatgctgcgctcatatatctcattatgaacacgttctgcaataactttagcatgatagaggttcttactagaataatctaactcaattgaaagaatcttttgttgagattcttcaacaatctcattaatagattttgtagaatcatttatatagtcattaagctctttagaaacatttaaaatgcttctgcgaacactctgttcttttacaattttcgcataaacatttatagttctatctgttggcaaataaactgaaagtgaatctaaataatcaggcaaattgattaaatcttttttaatcaaaagttgcgtttttgaaacatgcttagatacttcttcaaaaacagtaataggatcaatattttcccttttttcataaagcgaaaccattgctttgaaaatcaacttatgagtttcattgtaaaaatcatcagctcttacatgaaaagcaatttgctctatcttatctgaattataaaatatactagaaattaccgctttttctgcaccatcattaaaaagaagtgcagaattcgaaaaagctgctaaagccacaaactacacctctgctctttcaccttgctcatctgctttattcaactttttacttaaagactttttatcctcttgctttttttctttttttatctctactttaataatagagctaataccttcataaagcttaattgtcacatcataagttccaaaagtctttaaagttccatgatgtatatctattttttttctctctatatcaaaaccaagttttaaaagttcatcagcaatatttaaactattaatactatgaaacaatttgccagaatcattagatttcataaaaaattctaatttaacaagatcaagcttggatttcagatcgttggccatttgtttttttgcttcttgcttcttcaatattgatcttcttttttgattaaaaatctcaatattatgtttatttgaaaaaactgcaaaacccttgggtagtaaatagtttcttgcaaatccatctcttacctctacagtatctccttcttttccaagattaataaaatcttcctttaaaatcactttcataattaccccccaaataattatttttttacaaaaggcaacaaagccatatatcttgcccgtttaatttctaatgccaagcgtctttgatgcttagcagaagttccagtaattcttttgggtaaaattttaccttgctcggtaataaactttttaagaaaatcaaaatccttataatcaggatgtttaccagaatcacaaaatttacatgactttctcttaaaaaatctgaaatttgaattttttttaaagccatcctgctgattttcaaatcttgaatctctttgatttgtatccctatctttatacataacttaaactccattaaaaaggtatatcttcgctaaatttatcatcaacaatatcaatatccttaactacatcttcttttttatgatttgtcaaactattaacatctgaatcttgcatttgaatagtattagaacctgaactaaacatttgcaaattatctacaaatatatttaccttactcctcttatcacccgtattcctatcttgccagctttcatatttaagagatccacttaccacaacttgtttgccctttttcaaataatcgttgagactttcggctctttttgaaaaaataacacaatcaaaatattgtggataatcaatccattcatcattcttcttcattcttctattattagctatagaaaatctaagaacagccatgccactttctgtataagaaagctcagaatctcttgtaagcctaccagacaatactaatgaattaatatcagccattaaaaaccctcttatttttcctgaatatctgtgctttcaggacctgttggtgtttcaactttagaggcacctttaagactgtctttgtcaatattgtctctaaattctctaaaatttcttcttttgatttttttagtattgatctttctaactattttcaccaaaatcatatacctaagcaagtttctaattaacttaagccttgattcaaattcttttaaattattgccttccatactaaactctattatttcataacgacctctagcctgctttttaataggatattctaaggctctctctccaataaaattgctaacaacatcagttgcaccaaaaaactctaaagattttttaacctcttctaaagaacccttatattcaatttcttcacttttaaacaaaaaacatgcctcatatcttttaatcattactaaaactccttatggtctatcgcattgcaaaatatgcaacaaaggttacttagttagtatataaaagagactaatttttttcaacaataaaaatttttataatatacaaaatgtaactgaaaaataatcttaaaccctaatcttcttctaattcgctaagcttataggtttttcctgatttaccttgcttttcaagttttttgtcttctttcatttcaatataagttttaaaacctttttttacattatcaactgcaaccataacactagcttcaaaaagactctttggagaataggtatcaatggcatttttaatataataaacattagatccataaaaaagctgaaccttgccattaacaagccctattttaagaactccagcctctttaagcaaattattatcaacaagctcagtattaacaacatctacatgcaatcttgtagaacaaacatcaagctttgtaatattatcaaatccaccaagaccttgaattaaaagatgcgcaattccgagactctctagctttccttcttggccttcaaaaaatggatcgtctgtaacaaatatctgaaaatcaaagtatctataaagccaactaaaagtaaaataataaagagcaaaaaacattgcccccaaaggtaatacactaatccaatttgtcttagaatttccttgaagtatcccaaacataaaaaaatccaaaaatccagtagaaaagctattgccaatcgtaacattaaaaaaattagcaagcaacaatgcaaaccccgaataagcggcatgaacaaaataaagcaaaggcgctgtgaaaataaataaaaattctaaaggctcagttattcctgttaaaaaagctgtcaaggccccagagaaaagaagtgctgcaaccttatttttatcttcatgaacaatacccttgtaaacccctaatgctgctccgggcagtccaaacataatagatagataaaatccactgctaattttggcaaagcctgatgaaaatttaccaagtgatgggtctaatagctgagcataaaatatattcttaagacctctaacagtatcgccattaactatctccactcctcccaaagaagtaaactcaaaaggaaaagataaaatagaatgcaaccccaaaggcaataaaagcctatttaaaaatccataaagaaaactgccaaaatattcaaacctaaaaacaaacaaacctaaagatgcaattaaatcgtcaaaacttgaccaaatcaaacaaaaaaatatagccaaaaaaacacaaaagggtaaaattattactataggcacaaaatggcactctgaaaaaaacacaaaaggtttgggtagcttcatattataaaatttgttatgcaaatatccaactaaaaggcctaccgctaaagaacctgcaattcccgtatttaaagtttgaacaccaaaaaaatttatacgcccaacagaagacattgtctctgcttcaacaagccctgaaaaagcctcaataaaataattttcagtaatattaaatgttaaataaccaataaggcctcccaaagccgctgttccctgccccattcttgcaactccaatagaaattccaatagaaaaaattaaaggcatattgagaagaatagcattgcctatagccttcattaagcctaaaacattttgaataaaaattttatcaacataaacaatactagaagaatttgaaaatacagatccaataccaatcaataaacatgaaaccggtaaaatagaaataggcactcgtagtgctttagaaaatttttgcaaacttgaaaagttaattattttaataaaattaatcatgctaagcctctccaatgctaatttcagcaaacactattttattataaagctttttttgcaaaaaaaaactttacttactacacaagccaaataataaggttagataaatcaagcaagatttaatttgatcttgagaaaaagctacaattaaagtaaggtattatatattttttataaataagtgataaaacggaggcaaagctgtgcttagagaaaataaacttaaaaattactcgttaagcgatgttaatacaagcaaaataccaaaaaatgagctttttagttcaatctcgcatctttttggaattattttgtctatcattggaacaacaattcttgttacaatatctactcttaagaaaaaagatttacatgtagttgtattcttgatttacggattttcaatgaccctattatatgtaatgagcactctttaccacatattcccaaaaggaagtaaaataaaaaaaatatttagaaaatttgatcatatttcaatatttattctaatagcaggaacatatactcctgcatgtgcaatccttgtgccaaacaaatcaggactaataatcttatgcatagtgtggagcctggctataattggaataatttttaaaataatatttacaaacagccccggatggtttaatggatccatatttataatcatggggtggattatcatttttaaaattaagcccatttataaggccctcagcggaaaaggatttttttggctagtttttggcggaatcgtatatacaataggaggaatagtatacatattaagtaaaaaattcaatccaacaattaacatgaaaatgcatgatgtatttcatatattaataataatcgcatcagcatctcacttttggcttatgctaaaatacatttctaatttttaattaaatatatttaaaagacctttcaaatcattaaaaaggcctaaaccaaaaagaaacagcccaaaaaaaataccaaagctataaaaagaataaatggttttggccttaaatctctttccacgcaaaagctcaataaagctgataaaaatttgtcccccatcaaaaataggtattacaataaaaaatagattcataccagcaagaattaagctcaagaaagaaatgctattaatccaatacaatatccctaaagaataagatgaagagagaatgcctacaattccaacagggcctgatacactcttagaagcatttaaaaaatttgtcattaataaaaaaatagaatataaaatgtcttgcaaagcacttactaccttaaaaaaagaattcttaatggcacttgaaacattttctactttaactaccctttttaaaggtggtgaaaaatatatgccaatcattttatttttatcatgaaatactaatttagaagaaaaaatctctccatttctagaaaacttaatttccacaacatccgaatttaaattcttaagaaaataatctaaatctcttttatttttcaaaataacattatcaatgctaattatttcgtcacccggtttcattcccgcaatcttagcaggcgaatttgaaaccacatctgctattacaagatcagcccaagggccaatttcttttaaaaaatcttgcaaactaacagtctctttaaaagtaatattttctttttcccttaaaacatcaaacataactgtagatttttcctcaggaatgaattttcttaaatcagaaaaatatttaatttttttatcattaacctttaatataacatcaccgtctctaaatttatcttttaataaagaatctttatttaaaatactaactcttgaagaataatcaaaatatataacacccgccatacttataaaaataaaaacaataaatgaaaaaatcaaattaaacaacggacctgcaaaatatattaagatttttttaaaatgtgaaattccaaacaaagaatctttatctgcttctaattctttatttgccttaagctctttttctaagtgatcaaatcccttaagcttacaatatcctcctagaaggattggggaaagtctatactcagtattattaattttaaactttaatatgctaggacctatacccacagaaaaaacttcaaccttaactttaaaaagtttagcaaataaaaagtgccctagctcatgaataaatattataaaactgagagccaacacactaaaaagaatatacataatttcctccaaaaatcactaagataggtataaataaaatatcgggcctgttaaaagaaaagagtcaatcgaatcaagagctccgcctctaccaggaacgattttcccagaatcttttactccagcacttcgctttaatccagattcaaacaagtcgccaataatggtaaaaactccaatcaaaatgcctaaaataatagattctccatagcttaaatttattaatctaaaaactaccgcaaatatagcagtaagcacagaaaacaaaatgcccccaaaaaaacccattaatgttttatttgggctaataatagtgggacgataactgtttttccctaaaaaataaccaaaaagatatgcaaaagtatcgtttccacttaccatagcaaaaagcattaacattaaaaatggtgccttgggtaaggttgtaatagaaaccgtaaaagacattaataccccaggatatataagtataaaaagtattgacgttgcttgagacaaaaagtttccaatctcatgctctttaataaacaccaaatcaacaatccaattgctaaaaactaacgctataaacaagtaatatattacattcatgcctaaataaaaaacattaaaatgaatatatgttaaaattgggggagcaaatcctaaaaaaaaagataatatactcgaaagtcctgaaaatttgaattttaattttaataaatcattaacttcttttgccgcaaagccactaaatataaaaattaaaatattaaggaataaataatttttaaaatctaaaaatattaaaaataaaatcaaaggaacaaaaaatagaaatgttcccaaccttgcaaaaaaagcaaatctcttaaccttactcaacaaatcatctcccaaaatttcttcttctaaattggaaacattccaaatccttactatatctagtgtcataatattcaggccacaaaacatttgaaaaaattaattcagaataagcaatcctccataagaaaaaattacttattctaatatttccgcctgtacgtattaaaagatcaagatcgggtagttctggattgtctaaaaaactggaaaaaatattctcattcaaagactctaaatcaaaatcacttgaaacaaattttttaacagctctaagtatttcattacgacccccataattgattgctaaatttaaaataaggttgttgaaatttttagaaaagctaatagagtcttttatagaactttttacttccccacttaaagactcaacatctcctgaaactattatttttattccatttttttcgtaaaaatcaaattcggctctcaaataattagcaattaaaaacattaaattttctatctcacaatcatcccttctccaattctcagtagaaaatacataaaaggataaacatttaatacctacccttaaagaatacttaactatttcttttgctcttttaagaccttctttataaccttctaaagaagacaatcttttacctaaagcccaccttctattgccatccataataattccaacatgacttggaagagaacctttattcatggatttaagcttccattatttcttgaattttagattctaaaattgaatctatctttttaatatacatatctgtggatttctgaatatcatctaaaattctttttaaacagtcctctgtaatttccgattctttttcttgctttttaactttattgtttaaatcctgtcgtatatttctagttgaaattttatgttcttctgctatttttttagcatgctttacaatctcttgtcgcctttcactagttaaatttggaaccttaattctaataactgaaccatcatttgaaggattcatagaaagatcagaattaagtatggcttgctctatcttatttaagatgcttttatcccaaggctgaataacaacaagccttgcttcaggaattctaatacttgacacttgagttataggtgttcttcggtcatggtattgaatacaaattctatcaaaaatattactactaattctacctgttcttaacgttttatattcattatcaagtgataaaagaaccttgttcatcttttcatctagaaaagccttataatcttccatataaactcctccttgctgataaagagcacattatctaccctattcttaaatatttaaactcaaccatttctaccttgcttgaaattgcttttgaaatttcttcaagcatttcctttacagtgattttatcattctttacaaaactttgctcaagaagagaaatctcagcaagatgttttttgatttttcccgcaactatacccttgattatgctttccggcttaccactagattctaattgtttggtaaatatttcttcttgctctttaatataatttggacaaacatcatcatttctcaaataaacaggagcaaacgcagccacgtgcaaagctaaatccatagcaaaatttttaaaaattttatcttccgttttagaaaaatcatttacttttaatttaaccaaaacacctatcttggattgttcaccatgcaaataaatttttacaaactcattagattgaattttagtaataaaaatttttttaacctgaatattttcttttattgtagctgctaaatttttaagctctaactcttgagaagtagttaaagaatctattccactttctaccaattccttgatcaaggaattaccaaaattaacaaaattgtgattcaaagcaacaaagtccgtctcacaagaaacaagcaaaagcccagcataaatattgtttgaatatgagaatactctaccttcttttgcatctctgtcaagtcttttctcagcagatgcgattcccatttctctaagtttttttttagctaattcaaagtctccaccagcaacagacaaagcttttttacaatctccaaaaccagcattggtttcttctcgaagcttttttacatcctgaggactaataatgctcataaattactctcccctttcttcaatagaatcacttttatcgtttttaatttcaatttctttcatcaaatcttcttcattcaaattttcaattatttgaataccaacctctttatcactttctaaaatagcatcagatattattttagtaaacaaagcaacagagcgaatcgcatcatcattgccaggaattggacaatcaataacatctggattacaattagtatcaaccacagaaataatgggaatttttaattttctagcctcattaatagctatctgctctcgcttaggatcaatgataaaaatagcaccaggaagtgtttccatgtccttgatgcctgttaaatttttagctaattttgatttttcacgattaagttgtgaaatctcttttttgcttatcatgtcaaaagttccatcaacttccatcttttctagcttttttaatttttgaacagattttctaatcgtattaaaattagaaagcatgcccccaagccatctattgtttacatatggcatatcacttcttcttgcttcttgttctattatctcactagcttgctttttggttccaacaaaaagcacctttttgccatcttttattaccctttgaacaagttcataagaatctttaataccctgcaaagttttttgaagatctaaaatatgtatttcatttctctcagaaaaaataaatcttttcattctaggatcaagcctttttacttgatggccaaaatgaactccggcctctaacaggctcttcatagtaataattgccaaatcaacctcctattgtccttctcttttactcaccatgaaaacacacggcggaaattatccccccttttataagaatataataaaacaatccaattaataagtccacctcattaaaaataaacgtaattctctttaataaaattatcaacaaattatattaataaaaaaatattaaaagctaaatcaatatccaactcttttaaaaatcattcttttataaatcgttcttatttctttcagagaatttaatcaaacctattaaaataaccgaccccaaaataggaaacaaataaagaacaaaatctatttgcctttcataataatcggaatagaaaaaagggataaaaaactgaaatataattccacctaaaaagcttattaaataaactactataaatttaaaattcaatatgtttaaaaacgcaacaaaaaagcttaccaaaaaagaaataacaatgtttgttaaaatcaaatgagaaaaaaatactatcatgttcccccttaaaaagaactaattagataaactaaatcccgacaaatccccaagattaataagaacactataagcatcatcaacaatgctgcccacacccataacaaaaattgccaaattatacttgggggcaatatcttttgtaaaaaaatcctcatttatatgttttagatcaattggccttttctctttatctaaagaattggattttttaatagattttgaaaagcctacatattctcctttatcaatatgggacctatatatatttttcttctcaagaataacagatgaagaagtattcccattttttacagtaatgaaagcctcaccaggaacatcctttcttaattctccaaaatttatttcaaaatataaaggcaatttactatctacccattctttatttaatttaaaaacaggtttacccgaataaacagtagaactcaaatttattttataaaaccctctattattaaattcactaacattgtcaaaaacaccctttaaggcttcaaaatctttctctacgcttttctggaaactacttatgtgataattggcaccttctggataaaatttgtaatatatgtcaaaacctcttaatttaccagctgcttgattagaaaaataacccgctggtaaaaaaaaagctacataatctcttgaaattcgattatcaaccttttctggtgaaggaagtattaaaatattgtcaagaccacatccaaaaaaccccatacaaaatacaaaatataagataaaaaaaattataaaacctcccccaaaaatacagattaattttgcttaagttctaaaattttattatttgccatatttatatataaattattttcatacggaaacttaacaatctcttcgtatactttcacagcaagctctttatctttttcctcaatcaatattgccttactcaaaagagctcttacctttaaaaaatccaaactagtactattgataagatcttcataaactaacaaagcatcttcttttaatcccattttttcataaactgcagctttattaagaaaagcaatttcactttcaataccttttgccttaataacaatatctaaatctttaatagcctcatcatactgtgcttgactttggaaataaacagctctggctaaatagaaccttgaaataaaataagatgaaatttctttttcctttgaaataagctcccttatcctaagaaatattttttctctctctttggcatcattttcttttaaataatcatttaaatctttttcaagattttctactatttctccgccactctttacataatccttgcctaaagaattataaaaaacaacaataatagacacaaacacaaaaataatagcaataaagaaaactaaaagattatttttagccattattcatccctctttagcaaattctcaaatggcttgtaagattcctcatcattgcccttaaataaataagaagaaatttcttctcttgatctttgattttcatactccctataagagagcagcactgatttgtctttagaatcaatacttgttattaccactttaagcttatctccaacgtttaatttttcgaaagtttctaaactagattcttttgtatcccccaattgaattttactaataaatcccattattttattataaactcttacttgaaagccttttgattttttctctacaatctcaacctcaatagtatcgccttttttatagcttttagaaaaatcttcccaggggctctcttctagctgcttaattcctaatctaacatttctctttctcttgtcaacctcaagcactttcccattcactaaatcgcctatcttgaaatattcttcaggatcaatctcttcaagccaagaaatatcaaacttactaacataagcatctataccttcttcaatatttacaaaagcacctgtttttgtaatattagtaacaactccttgaacaacccttccaataggatatttctcagttaatctctcccaaggattctcattgatctgtttaatgcctagggatattttttgattttctttatctatctctaaaatcttaacttctacaatctggccaagttttattaattcttgaggactttttactactcttatccaagaaaaattacttatatgtaaaaatcccgacaattcgctgtcaagttcaataacagccccaaagggtaaaatttttacaactttcccttttacaatgctatcaattttatatttaacatctacagaatcccaaggatttgcttttaaggccttaagagacaattccattttgcctgtttgtggatttatcttaataattttcaactttaacttatcaccaactctaacaaaatcttcaacattttcaacttgattaaaggcaatatttcttttatgcaaaattcctgtaacaaaatttttaatttttacaatcgcaccatattctgtaatacgctcaaccacaccatcaactacatcttcttcattataagaactaactagctctattctcttagcaagatctctttctttttctagggtgcgtctatcaagaataagtctcaaaccgtctgcttcgcttgcttcaagaatataaaattcaacaacagaccctctttttaatttctcatccttagatttagagcttaaataaaaaggcataaagccagaaacattttcattaatttgaatcttataaccatttggaagctcaaccagcaccttgcctttaattatttttttattttgaatatattcatatactttatcttgaaaatttaaagaattaagcttttcaacacttaaaataagacctaattctccacctattcttacaacgattgcttcaagtctatcaccaacttggggaacgttttcaaattcttcaatcttaataaagccttccgatttataaccaatatctactagaacataatccttcataatgttaacaactgtcccagaaacacgacttccaagttctactctttcaagtactttcaaataattttcttgtaaatctttttgattttccattctcacctctctcttacttttttcaaattaaacttttctattataatattacacacatcgtctaatcctttgtagcttgtatcaaggtaaaaaaccccttttgataattttaacttaccatattgttttttcttgtcaacatcatctcttcttttaagagtacgctctaattcttctaaggtctcattcccatttctttgcttatatcgcctcaaagctcgaactttaacagaagcatcgagatatattttaaattcagattctggaaaaactacagtagtaatatctctaccttctattatataattatcatcgctaaatttaacaacctctcttaattttttattcacaatgtttcttattccaacataagaagaataaaaagaaacttgaaaatcaatcttatcgtttaaaatttgattttcaacattctctccattaagcaaaaaggcaaaattattaaaacttatatcattctcaagaatcaaatttaaaagactatcctcactaataaaatcgcaactattcataagagatctttgagcaattaaagttattatcctgtaaagatgcccagagctgataaatttatagttcagccttacgccaagctctcttgcaattgaactttttcctgatgctgaaggtccatcaattgctattatcatttaatttctccagcctggattttaaactatttatcttagacaaaggaacaatttttacttgaccctcctttaaactatctaaattaatattgccaattctaattctatgaattttttttaaaaaaatattcttgctcaaaaacacttttcttatttctctatttttcccttcatctaaaatcaatctagcagaatttttatttaaaatttcataagattttaatttaaaaaattctttttttacctttatacccgatttaaaagaaataagcaaattttcatcaatatctttttttgattcaataatatattctctttcaactttttgccttggatgaataatatcgtttgcaaatttaccatcattggtgaataataaaagtccagagcttttaaaatcaagcctaccaattgaaaacacacgctctttaaataagggctgaaccaaagatattgctaactttcttccatcaacatcaaaattagaacataaataatttctaggcttgttaagagctagataaattctattattaatttgaaaatctttaaaaacaaaaatctgttttttataaattattctgtctcctaaagttactttatccccaagcttagcaatagtgttattaactcttacaagtttctttcttatcagttcctcgcaaaatcttcttgaccccactcccttttcagctaaaaaaacgtgaactctaggggctttaagtgcaatcattaattttacaacctcgatacaatactaatttattattcaaatatcctaaatttacaatattaagcattttacactcaagagatactaaaaaataagaaaatctctcaaaagaataattatcggcattaaaatctaaaagagaatcaaaaattacgctactctctttatttaaaatagaaataattttcatctttttttcaaaaattttcaattcatatttattgtaaacagctttaaattttttatcacacaaaaaatttttattaataacttttttcttcaatgtaccagactttctcttcaaatttttctttttattattatcattagcagtagcattaatatttttaataaaattgccactatcgccaaaaataaactcttcaataatttttgagtcatagaatttaaaatttttcgcttggtttaattgtaatttttcattttctctattcttgctataacatattaatctttccacaactttgcgctcagctttatctttgcattcaaacttcagtgggaataaaatttgagttttccaataaaacaaattattagcaagataaaaaaaatcgatcaatcccctaatacttatattaagatcacctgaaacaactataaattcttcaattatttgatttaaactcaaagttctcaaaacatgcctattcatactaacatattcaaaaaaaagctctattccgcctgtaaaattatcaaggctgatagagtaactacccaattcagacatttaaattttccatattactcagattcatcttctttaaattcaataaaattatcattctcttgatcaaaattattaaaaattatttttctaagcctcttatccaaattatttgcaagttctacttctttgctaagatactcaataacactctctctcccctgtcccaacttattatctcccaatgaataccatgagcctgttttttgtattaaattatgcttaatagcagcatctaaaatgccagcttctcttgaaatacctttcccaaaataaattatcaattctactttacgaaaaggtggagcaaccttgttctttacaatcttaactctaatcttattgccaataacatcatcgcttgagcccgatctagttacttgttcgatctttcgaacctcaagtctaagagatgaataaaattttaaagcattcccaccggtagtggtctcaggattgccaaacataacaccaatcctcatccttatttgattaataaacataatgcaagtattggatttagaaagtataccggtaatctttctaagagctttgctcattagccttgcttgaagaccaatctgagaatctcccatttctccatctatctctaatttaggggttaaagccgctacagaatcaactacaatcaaatcaacaccaccacttctgattaaatgctcagcaatctcaagagcttgctctccggtatcaggctgactaagccaaagttctgcaacattaacacctaaagcttttgcataaacaggatcaagagcatgctcagcatcaataaaagcagctatcccaccttctttttgcacctcagcaatcgcttgaagagttaaagtagtcttgccagacgactcggggccaaaaatttctattatgcgccccctaggatatccgccaatgccgagagcctcatctaatacaatagatccacttgacatactttttataccttgtccaacaggagattcccccatcttaataagacttccctttccaaaagctttttctatttgaactcttgcaagctcaatagcttcctctttacttgccctttctatgccaacaacagctttttctcttttttcctttaactttgacattcttaaatttttcctagctaaattttatgggttctattttttttacaaaatatttaaaattagtattatttataacaaaattaagactatccccttccctagaatcaagcaaattttctccaaaaggcgatttatatgaaataatgccttcatcggggtttgattcccaaggcccaagtattaaataagattcatctttgcctgtaacttcatttaaaatgacaaccttggtcccaaaaccaacaacagaactttgaagatccttagtatctataacttttgcattctctatttccagcattaaggagtttaatctttttgtcaaaaactgttgtttttccttagcagaatgatattcggcattttcttttaaatcaccaagttcacgagcttttccaatttcttttgaattttctggaatttcaacttcctttaaatatttaagctctttttgttttttattcaaagagcttaatatggttaaaaatccaatttccattctctcgcctgcaagttgcatcttttcatcttcaaactcaaccgaatcaaataattgtcttattatagatttaatctctaaaagatcctttggggggaaatcttttacataaaaacaagtcatataaactctttttgcaagttcttcatctctcacgacctctaagaccgatttaagatatccatctttaactaaaagattaattaccattttataaattcttttacttgcaacagaattatttttattattaattttgataacactatctgttaaaattttaatcaaattggacaaaagatccgaatccgaataactcagctctatagaataagctttacagtgcttcaaaatccaaatataagcatctttatagatcttataattttttataacataattaaataatttttccacctctctgggatcttctttgtaaagtgattcaaccaatctcttattaacagaatgaggaaaaagttctttgtagtataaaatccaattactaagttcttctttaattaaaacaactaattcttttttaatttctgcattcaaaattgaatcaaaaagatccactattccttttggatactcttttaaaagagattctaaattaacatctttttctatattaacttttgatgacaattcttcagaaaaattacctaaagatttaagaataacgtaagaacttacaacatgatgatcaacctttgtaaaattgttaacataaattaaaaaatagttaagcatctcttcttcaatatgcaaatccttaacaattcccttaacattgcaatagtttataaatatctcgtatcttttataaaaatctttctcaatcttaaatttatcatacattttttcattcaaattggaagatctctcattatatatataacaatcaagcttgccagaatccataacaaaatggggattatcctttaaaatttgctttgctttcaagctccatgaattccacgaactttgagtcatcaagcttggcactaactctttttttattccctttaaatcaatagctttataactttttataataacctttatggcccactcaatatctttttttactctatctgcaagttcttctttaggtgttacagcctttaatactctaatatcctctctgctaaggggagataaagccgacatggccatatcaaaaccaataaaatgacctcttttggaaacaaaatcaaccgtaatgccgttatcatttacatctcttactattccaacagaccaagtctgatgataaacaaaattaccctttgcaaaaaacaaatatttttcaaagtctaaatatacatcaacaaaatttttatctaagttttcaatatcagactttacaagataatcctcaatatttttaacatctttatatctttctcttaaaaatttaactaaattttctcttgccttatgatttttgttatcaagttttaaaatgccttttaaaatttctattgtctcgtcaacattgtcagtcaaagaataatgatcaaataaatcctcataaagaactatggcctttttaaatccaagatctttttcaattttttgcaaaataagcaaaaaagaatcaaaatcatctgaaacataatgaataagcttggcccatacttctctgattcctgacatttgttttttatcaataaaacgataaatagcttttctaaaatagaaaattgatttttgcaaatcaatagtttcataataagtagcaagttgcctaacaaacacagtgtcgtcaatatctgcttcaacaattctagtccaaatacctggaagcttatcattttcattgttctgagcatatatttttgcaagagtataaagagcgtgcttattctcagaaattaaaagcatttcattacatatatgctcaacaagagcccattttaaattttgagaaaacaaatcaataacagcaagtaaattcatatcatttaaaggtcgcctactatatataagcattccagaaatataaagacctgctatgctttttttaacgtcctttaaatgcctgccacaaatatcaagcacatcctctgttaacccctcatcaattatattatttattaaatcatccaattcttttattttggcaagagaataattattaacaactattcttgtccacttatcttcttgtaaaatactatctaatttctctatggtagtaacattagacattaaactctcctaatatcgattttttagcatcaagcaactaatttacatactgttgataaatacctaggtctatttcttttatgtataacaaaatctcatcaatacgtgctctatcttcttttatccttacataatgatcaataagccaaaaatatttattaataagccttggaagcaatatgctctcatttattgatctataagacttttctttaagctcattgcgcaaactgtaaacagactgctttagctgtccaagctctataggccttaactctcttttaatattaaaaacaccattaagagagccataaacaggaatccattcttttataagatcatctgaaatatttctgtcagacttaataagatctattaatcttaaaatcatatcagactcaagagaatatatatctatcttttgaggattaataaaaaaagcctctctgaataatactttagcttctttaatttcatcaaccaacgcataagaatcagcaagctctgcaacaacatctgagttatctttaaaatctcctaatatttgcaaaaaaacattgattgctctctcgtaatttcccatacccttataagacttagcaatttttattaaaaggtccaaattttctggatgcattttgtatatatttttatatatataaagacaggtctgaaacacaaaatattttatagaattgcgaccttgcaaaaaattacaacccatctttttcaaatatcgtcctgcaaaattattccactctcttattaaaaattctgccttttcataatcttgccctattctatcaaggctttcaacttgaccattccaatacacagaacttttcaaagctgttagaatttcaatattatcaaaatcaagagaatgagcctcttcggattttactaaagcttctttgaaattgccttttctaaaatctaaataaatctctttaatcaattcaacgattctttctgatgacacattcccaccattttaaacaatatatacaaacccccgttacactttatataattatatcatttatcaatttttagtcaaacaagaaattagggcaaaataacaatatttcatttattattcttttaaaataaaatcttatattataatattaaaaagaaaattgtggagtcaaattctagctatatggaacctaataaaattatcaacaagtctatttattactataattcaaaaaaatattcacaagcaataaaactcctagaaaaagaaatttttttctacaaaaattactatttgtatcactatgtcttaggaatgtcttatcttcgtatcgggaaccttggcaatgctcaaacatatcttaaaaaagcctacactttaaatccaagcgaatcaaatataaaacaggctattgctatacttttagtaagccagggcaaagaagaaaaagctattcagatatggcttaaaatgatagaagaaaatcaagaagtagatcgatcagagctgtctcttgaaattattcgaaaaaatcccattaaaggttctgccttttttaaaaatagcaacctatatgaaaaattgttcccaacaattaaagcaatacccgataaaaattcaacaaagttaatcataataattatcataggggggattgtatttatttcaatgttagcaatctattttattttctatgaacaaaaaacaacaacatccgcaaatctaaaagcagaaataaacaaaaatttaaacaatattgctgcctacattgatgacattaaaataaataacaaagaaaaaataaaaaatgaagaaggccaattcatattaatactaaccagcgaggaaattaaaaactctttcgaaaaaatcaaaatttatttaaaaaagggaaaagataattttgcaagagtagaaataaataaaatattaaattcaaatgcatcagaatctataaagctaaaagccaaaaatcttgcaagttttatctcaaggccagatttcattagctttaatgaacatctaaacctaaaagatattaaaaaagatccatcaatatattcaaacgtgtatgtaaaatgggaaggagtagtaaataatatcgaaaaaaaagataacataattcaatttgacttttatgtaggatacaacaaaaatgtactctcaggaattatccccacaaaaacaacctttgatattgatattgattttaaagacaatgttgaaatacttggacaaatagaatacaaaaagaacaaacttaccttaaatgcaataacaattagaaaaatagataaaaatgaaaattaatcctaatatctttgccaaaatttcaaaaaataattaacatttaagattaaaaaggggtgcacaacaacttttcattacatttgataagatttattgattcttcaaaagaaagcagcaactcttctttttttgtcaaatctcttactttcattttattttctttgtattcttcttgaccaacaaaaactaaaaatcttatttctttgcttaaagcatattctatttgttctttaatatttttaccatttttatttttaaaatagacttcacaagaaatatttttaaccttggaataatcatgatttctaaatctagtagcaagttcataataataattttgcaaagcactatctaaatttacaattaaaactttagatctagccttagtgacaaatattttaatataactaaacttttcaagatcaattatatcctttattctgtcaacaccaaaagatcctccaacccctgaaattttttgaatagagtttgagaacgaagaaaccaaattatcatatcttcccccactgcaaacactacccatattactgccaaacacctcagattcaaaaacaatccccgtataataatcaagtccacgcgatattttaagattcaagttaaaagaatcttgaatttttaataaactaagatgctgaaaaacatcttctactctcttgatagactcattatcgcctaaaatactttttaaagcttgtattttgtctttaaaagtaccttgcaaactcactaaacttaagattgaatctaccgcttctttttcaatctcaagaagcaaagcttctttaaccttatcaattcctattttatctattttgtcaatatttcttaaaataaaaatagatttttctttaagtcctaatttttcaaaaaaagaattcaatataccaatatgagaataatggataataaattttttattaatgccttctataaaattcaaaaaaatctcttcaagtccataatatacaacagaaagaatctcggcatcgcccctaaaagtgtcctctccaactatatcaaaatcaaactgcataaattctctgtatctacccttttgagaattttctcctctgaaaacttttccaaattgagaacgtctaaaaggaagctttaaagcagaaatatttgtagcaacaaatctggcaaaaggaacagttaaatcaaatcgcatggaaacatctctgcctccattatccttaaacctataaatttgcttttcagtctcatccccactcttttttaaaagcaaatctgaatattcaagaactggagtatctattaggtcaaaattataagaattaagaacactaaatatttgcctaacaatatgaattcgaatcaaagaatccttcggtaaataatctttaaagccttttaaagttttaatatccatcacattataccctctgctatatagtaatttactttttcagaatataataacatataataatatagatgcaaaaaaaaatgaataattttttatttcatatagtcataaaataatttaagaggtccaaaattcatgaccaaaagaatgcttaataacacttatcgaataaaaacaatattaacaatattcttggctataactttgttaactatttacaaatatttcacactaatggccttcaataacagcccagacaacacaatatctttaaagtcaaatgatattgccaaaagaggaacaatttatgatagaaatggcaaaccaatagcattctcttcaaaatcctactcaattggtacaaatcctcaaaaaatagaaaatattgtaagcacatctgaaactcttggtgcaatacttcaaattaattcaagaattttaaaggaaaagctttcctctaacaaagggtttttatatataaaaagaaaaataaaaagagaagaatcagatttaataaaaagaattcaagctgaaggcaggctttcaaacatcactttatatcctgattacacaagaatttatcccttcaggaataccacaagcaatattactggttttgtaggaacagataatcttggccttgagggcattgaattttccctaaatagcatattaggaaaagataaaaccaagcaacaatttttaaatgaggagccagaaacaaacaacatccacttaacaatagacatggatatacaacaaggtgttagcaaaatagctaaaaaatactttaaagaaaataatcctgaaagtttaattaccttggtaatgaactcccaaaatggagaaatattatccatggttcaatttcctcaatatgatgcaaacttttattctaaatatcctgaagaaatccgaaaaaacctttcttcatctctaacctatgagcccggaagcattaataaaatttttacagttgcaataatattagaaagtggaaaattaaatttagaagaaaaatttttagacaatggaatatatcaaaaacaatttccatcaggagaaaaaattacaatcaaaacattaaatcccccctataaacatatcgactctacagagattttaatttattcatcaaatgttggaatagcttacattactgaaaaagttagcaatgaatacttttataaaaaacttttagattttggctttggggaaaaagttggagttccatttcccggagaaacaaaaggactgctaaatcattattcaaaatggtcaggacgaagtaaagctacaattggatttggacaagaaataggagtgtcagcggttcaaatattacaagctgcaagcatactaagcaataatggaataatgctaaaacctagaataataaaaaaaataagcaacgataaaggagaaaatattaaagaatttgataaagaagaaataagaaaagtaatatccaaaaattcagcacaaaaagttttaaaaatgatgagagaagttgtaaataaaggtggaattccaaatcttaaaattaaaaatcttgacatttctgcaaaaagtggaacatctcaagctattgatagaaaaacgggaaaatactcagaagaagactatacatcttctatattggcaatataccccacagaacaaccaaaatatattatttacattgtatacagatacccaaaaaaaataatatacggaacaagaatagcagccccaatggcaaaagaaataatagaatttattgagcaccaacaaaatacaatagcatataaaaaaattaaaatgccatcaaaaatcaagatccctaaagctgaaactaattacaaaaacaaaacatacttaccaaattttatcaacctttctaaaagagaagcaatagacatactaaaatactataaaaatactatgaaaataaaaataaatggcgatggatttgtttacaagcaaagtatatcccccaatacaaaattagaagatataacagagcttgaactgtatttaaaataattgggttaattaaataaataaatttttaatttcatttttataaaaatttaaaatatagcttcgcttaatgtccattttaatagacatttctttaccaacttcaaatggtttttctaaaagagtaaactttaatatctgctcaaaaggcttaaatccattggctttattgattaatttttttatttcatcatttatggccttaagaacaatattattcgcaataatttgacgcctattattagcatcaaaaattttttgtccaacactttctagatatttatttatttcttcaaaatttggaagaataagagcgcctaagaatttttgatcttgccctacaacaactgctttttctattaatgctgattcttcaagcttaatctcaattggagcaggctcaacattctctccattattcaaaacaattgtatctttttctcgaccaataatttgaacaacattatccttggataattttgcaatatcacccgtgtttaaaaacccatcagaaccaataatcttacaagttgcttctttgtccttgtaatatccaagcattacttgaggcccttttacaaacaaaattccctttccaggctttttaagcttattcccatcaatatctctaatttcagcaacagttccgggcaaaattttaccacaagtcccaataatcacttttttatgcttattagaagccactccaggcgaggtttcagtcaatccataagcattggcaagctcaataccaattgaattaaaaaatctaacagcagacaatggcatactcccgccaccagtaatcccaacaacaaaattattgcccaagatcttatttattttattaaaaattaaaacattccccaaagccttaaaaggaaatgcacagattaatccaaatattcctaaaattttctttatagggaaaaataaactaaacccgttgtccggataaagccccattaccaccctatagcaaatatcgctaagaaatgccgcttttacaaaaaaatgaaaaatcattctagaaataaacggtttcttagaaacttctttgtaaatattttgtcttattgcaatccaaagcctaggaacagctgcaatataatgaggattaacatttttaatatcatcaagcattgcccttggaacaatggtggaaaataaacaaaccatacccttgaggaaaatattgtaagaaaaagacctttgaaaggaatgccaaattggcaaaatgcacataaatatttgtcccacatgcgtatcaaccattaaactaaaactagaaacctgataaagaagattggcatggctgagcattaccccctttgggtggcctgttgttccagaagtatatattattgttgccatatcattagaatcaactttacttgcaatctcaataatttctgaatcttttcttaaggtatctccaaataaaatacaatcgctataagtataaatttcaaaatcactatattttaatctatcctcttggtttaaattttcaataataataaatattggctttactgtaaatttaatttgaataaacatattaagaagatttaaattttctaaaataactacacttggaagaacggagttaaaaataatttccgcttcaaaaagagtaacatcagaaccctttggaatatcaacggcacccaaagataaaattgcaaaatctatcacagtccactcagccctattctcagagcaaataaatattttatcttgatgcttaacattgattgactttaaaaaggaagcaagctttaaaacattgttttttaagtcgccataagtaacgtgggcatatccattgcaaactttatacatttgagcaattttatctttttgttgatcagccacttcaaaaaatgcctttgctattgacatataatcccccttttaacaaagttaacatggtttattatatcattattaaccataaattcataaagattatttataaagctctcctgctgtaaaaacatacagaaatcgatcaattaataaaaacctaaaaaatcaaaacaaagtttaaaaaaatattttaataaaaaaataattgaaaatctagaagtaaatttcaatttcaatattttagcaagtaatatttttttcaaaataactaaaacattaaatattatccaattattttcacaaatataataacaatgtttaggatctattttatcacctttaaaacaatcagtcactctttctaaaaaatcttcttatttttttcttcagaaatacaggaaatataattttcataggctttaaaataatatttatctgatcatatttatctgattttacttgaatacgatgaataagcctataaaatatattgactctgactttaaaaaaagaatgaaaagaaaaaatttttgtagctattgaaataaaatagtaaaatttattttgtaataaatatttatcatttaaaacaaaaagcccacaaacaaactttgatcgcgtgtctataatattctaataactttaaaaaaaattattaaccactcccttgttaaccaaaacagcaaataaaattttacccttaagaatttctcaaaacaaaaagattaatcccttctgtagggtaagaacgattcaaatcatccacaatatcctttaatcgctcaacaatagactgattggaggtataaataatcaaaataaaattttcttcaggccaaacgccattaccatgcttttctcccttcttaccttttccataaacatttcctatcttagaataatatatagactctcctaactcttgctctattttttctatacattcaaaaacatcaagctctaaagataagttagaaactatttcaatcctataattataaaatttagtcatatcattccccatcttcttcaaataaatcatcataactacttttagttgaattattaattttgaatgatttttcaacatctaaattggacgtcactctttttagcctagatttgaaacttgaaacatgttggaaaaatttcaaaaagcatgggaataaaaaacaaagtaagaaatgtgctagctgtcattccgccaataaaagtaaatgcaattggttttagaagttcatttccacttccgctagaaaatgccattggaataagccctattattgaggtcaaagaagacattaaaattggcctaagccttgaacgacaagattcaataattgcttctcttaggccaaatcccctcttgatcaataaaccagtatagtctacaagaacaattcctgtatttaccacaacaccaacaagcataagcataccaattgcagcaaaaatagaaagcttttctcctgcaagaaaatgtataagcacaacccctattgccgttaaaggaattgtaaaaataataataaagggttttaaaaaagattcaaattgagaagccataataccaaacacaacaataatagccatcataatgattattttaaactgattcatgatatttgaaaattcattatattctccttcaaccttaagagttatgccttctttatggggcaccttattattaataaaatctacaacttttgcggttacttgggttaaattatcatctggagaaatacccgcattaagataaatggttaaagcttgattttctctgtaaatagattcggctttattggttttttcaaaggtggctattgatgaaaaaggaattttaactccagatgaatttgtaataaatattttttctaaatcttttaaatttttaacatccattctatcaagcttaagaacaatatcataattaagtcccttctccacatattgcccagcaacaacaccattaatattggccttcaactcatttaaaatggtattcatgtcaataccataattataaactagcgctctgtctatctcaacgccaatttgaagctgaaaatcacttatgctaagccttggatttacaagttcgggaatttccttttttaacatggaaactaaaatttttccataatcttttatatattcaaaatcattggccgaaattttaattttaatagaatctccaccacctaaagcattgccactaatggaaggctcaatattaaattcaggataaagattaccaatacgattcataattttatatttaatagaatcgtaatctacgctttgggttaaattatctcttgattcttctttgagaggaaacaatacgttgaaagttattctatcagcacgcaaagtagcaataatacttttatatcctttagcctcactttttacaatttctaaaaatctattagaataaaattttgcatattccaaattagttttgtggggaaaatttaaattaatagtaattgagttctctttccctctagtaaaagttgtcacatctaacaataatcctaaaagcaagctgccaataaaactaaaaaaaacaatcaacccaaaaatcaatttgtgatttaaaactatatttaataaattgatatacaaaaactctaaaaaataataaatactagcaaaaaaggcatcgattttcctaataaaagcattcttaatattcttttggaaacttgtgtataaaccgacatagtggcttgataaaacaggaaccaaaaaaattgcaactaaaagagaaacacccaaggaaataacaatcgtaaatgtaaagtctttgaaaaaatctccatataccccaagttctgatttgaaaataagaaatggaccaaaaacacaaatagaagtaaaagttgaagatgtaataggcaacatcatctcctgagctccgagaatagaagacgaaataagctttgctcctttttgcctatatttgtatatattgtctattacaacaattgaacagtcaacaaccattccaatcccaagtgcaagacccgcaagactcataatattaagagaaatatttacaaaatacattaaacaaaaggtcaaaacaattgctattggaatagaaattccaataattattgtggccctaaagcttcttaaaaagaaaaaaataacaaatattgcaagcatggccccaaaataggctgaatttacaaccgttgaaatggatgctttaataaaatcagtactatcagaagcaatctccaatttcatatctttaggcatagataatttcaatttttctatttcattcataacaacattagaaactgcaatagaattagaatcactacgtttttgaaccgacaaagaaattgaaggcaacccattatattcaacatattcagacaaatcttcaaaatcggttttaatattagcaatatctttgagttttatctcaataggagataaatttatgccagaagaaatgtcgggtatcttataagctatgaccacattacctatctcttcaattgatttaaattttccagaaacttcaaccaaatattccaarttgttctccaatatattgccagctgaaagttccaaattttgggatgctataattgaagatattcttgacaaagaaagcccataagactccagcctgttttgagaaacttcaattaaaacacgctttttacttccaccattaacagtaacaattgcaactccatcaagcctttcaagcccaggtttaatgatttcatcggcatatcttttaagctcagaaactggccttacagaattaataacaatttccattacagggatgtttttaagattgtatctaaaaattcttggggtctgtgatttgctgggcaatgaagattttaccaattcaagagcatctcgaatttcatttaaaaccaaatctaaatcggttccatgataaaattcaagtgaaacggtgctgctttctttggaagatacactatatatattttttaaattctttaccgaactcaagccactctcaaggactctagaaacactctcttcaacttctctaggagaagcgccaggataaacagtgtgaatacttatttggggaatgtcaattcccggcaaaagatctacttttaatcttgaaaaggtatacaaacttatcatcaataacaatgaaaataaaatcaacattgttattggtttgccaactattctctttaccaacataacacatcccccaacaaattaaatattgctttcggctgaaagaccctctttggtatctaccaaatttattagagatccattagaaagagcagacatgccttctactacaattaaatcattctcttcaacctcgcccgaaagagctacaatgttatctatttcaaaaagcactgtaatgggtaacatttgaacactcttactctctaaatcaaccttaaatacaaattttttgccctctctctcaacaacagcctctcttgaaatcttaattacatctttaaatcgcttagtaataagtttgattttagaaaacataccaataatcagtttatctaaattactaccaataggcgtaagatatacttcgatagttcgacttttagaatctaaaatgggagatatttctgaaactttagctttaaacttttcattagaataagctccaacctcaataatagcatcatttccaactttaatatttgaaatgtatttctcagacacataggttaaaatttgctttgtatctatccttcccactactgctatgttggactggggattaactgtttcaccaattttttttgtaatatttaaaatatatcctgagattggcgctcttacaggacttttcaaatatacagaaccaggtcttgaaggatcaagagttgcaactatttgtcccttttgaacataagctccaagttttattctcaaagaagttattttgcccacagcgtctggaaaaatatctgccttaacttttgtatctacatctccatttaaagacaaataatcgctcaagattccctttttaactttcatagcaattactgggaatctataggaactttctttctccttatcaatatttttgtcatctagcttgttatcaccaacacaagcaactaaaactaagaataaaactaaaaaatatttttttaaatataaattaatattaaaaatcaaattcatcaaaatacctcttagtctaatgaatttattaaatttttatattcaagtatagaattggcataatttaatttatcttcaatgaactttaaatcgctctgcttataaacaagttcaatatcatttaatttagaaagatccatgaccccggaattaaaagcattaaatgccatttgataatttttattcgctaattctacattaattttagaagcatcaagaatcgctttatatcttctaatatcttttcttttttgcacaatactagattttaaattcctgattttaccttcaacattgttttgtagtatttttagctgatagttgttatcttgtatttttgtaaaactctttgaaaatggaaatatttcagttaaaccataatttaaactaaaggatgctaaaaatccagttgaaaagcccttggaattttcatgaaatgatttataaggagagtaagaaaatgacaaagaaaggcttggcaaataagtatctaaccaaagcgaatcaatgagctgctcggtcatttttaagcgcatattcaaatccttaatctctaatgattcattaaaatttaatgcctcattaaatagagaaaaatctattgtttcgtctggcaattctccaataatttcaaaatcttgatcatgatctaatcctattaataatttgaaaatttcttttgatttttcaaaattaataatatgaccatccaaatctggttgagattttttatacttaagctgagcatcaaggaaatctatttctgatattagtccattgttataagcaattctagcttgttcaaatttaagtttactattttgtatttgactctcaaaaactttcaaagtgctctttaaagctatcaattgattgtaagacttaagaacatttagcttgatattacgaacagcactctccctttctatttttgcgctttcatattccaacataacaagttgcattctctttaaaacagaaggggacaaagaaagattaatcccaactccaaacccaaaaccccaataatctctttcaagctcactcaaagcagaaggatttctactaagtgtagagctaaggttaacatttggaacaaaaacattccatgcattatttttataaagtttttttatattttctttgtacaaagcattttctgaatccaagctattttctaaagccatatttacagcttgcttgggggatatttgaataatttcagcaaaagaaaaagagacagtaataaaaattaaaaaaatttttttaatttgaagcccccttataataaaaatcaaaactttaaagttataaaacttaattaatattttcaattcatttgattaattattataatataatacaattctaagtatgaacatttttaaaattttatttatcttaaattatgctcttatttttctaataaaaatttaccaaaatactttatctaaaatatttggactacaatgcatatacaaacctacctgctcaaaatattcaattgaatgtcttaaaaaatacaattttttaacggctttaatattaatgacactaagaataataagatgtaacgcattattcaaagggggaaacgattttactcctaaatacaaacccattttagaatccttaaaagaatttaaaaaaagattaatcaaataaggtcttatatttttctggaacccacgtctttacaatctctttattcttttcaacaaattcaaccgcattgcggtattctttgcctggctctttatcatttttatccattaagggcaatattaaatcatcgctccaataaaaatgatcaaaaacataatatgcatcaaaatcatcattttcaagaccaagtctaacaagagtatgcacgctctcaattccccccataattaaatcaggatcatcaagaaacttaatatcatacctagaaaaagcccaatgaggcttccacaaaggaactaaaatccattcgtttctctttattgaagaatctaaacttgcaagcataacactctcacttgaaggaactagctcatactctttacttaatccataataattaagcgcttgttctgtaacaatttgagttcccgcaccagcatctatgccaatcattttgtttttaaacttatcacctttacccttaagctcactaatgctggaaattggaacatagcttggcaccacaaaaccttgaatggttccttcataatttgcaccaagatcaacaaactttgttttcagtttttcataataaaatttatcggctgtaggaacccaagaagacaccgtaccgtctatctttccagatgctaagtattgatacattatagacgtagtaactgaaaatatttctgcattgtagcccattttctcaaaaacaacctttaatacatttgtagctgccgtttctccaccccaattcacatatccaatttttaccgattttaaattctttgaactctttttttcatcacaagacaaaaacataaaaataataaaaaataaaaataatttatacataaaatatcctccttatttattatagatttctaagaatcttttaaatttattctctttctttccaccataatgatctgtgtttaaatagctaaatttaataaagatagattgcataatcctatctaaaataatagctataataacaactgctaatccagatattaaaccctcaccaaaatttaatctttctatagagtaaatcacagttctgcccaaaccagacgatccaaccattgcagcaattactatcatagatatagccatcattattgactgattaataccttcaattatactttgaagagaaaggggaagttgaacttgaaaaagaatgcgcaaattactactaccaaaggacttagctgcctctattacctcatctgaaacttgaacaattcccagccttgtatatctaataacagggggcatagcaaaaactattgtagcaaaaatagcagaagctgtacccattccaaaaaaaggaatagcgggaatcaagtaaataaaagggggcatggcttgcattaaatctagaataggtttcaaaaaaacataaaatcttgggaaatatccgcccaaaatacctataggaattcccaaaataacagaaactaatacagaaacaaatataatagctattgtatccattgaagcttcccaaagattaaaatacaaaataaaaaagaatccgggtaaaattaaaaatattaacctcttttttaaaaaaacaaaacttagcaaacatacagtcaaaataaaaagaagtgggttaacaaaaagaaataaattttttaaattttcatataaaaaaattatacttttagaaaaacctactccatcagaaattgaaaaattatcaaccaaaaaatcaaaaaaattatctatttttaatataaaaaaatctttagtcataaattcctatcttgataataaataagagatttcatttaaactaatatatccgacaacagttcccttttcttttattattaaataatcttgcttatttaaatattcaacaattttttttatctcatcgtttagatctaaatttaaagatacaagattatcataccttttgttaagagctttgtcatacaaactaaaattttcaccttgacatttaataataacatttaagccattatcaccaccagagtttaaatcaaaatcatcttttaaaatatcttttatttttaaaatatttaaaacaggtaaatttttaataaaatcagatataaaatctgtactaggattagctaaaatttccaaaggtttgccaacttgaataatttttccatctctcataaaagcaattctatgtcccaatttaaaagcttcatttaaatcatgggtaataaacacaactgtttttttaagcttggctactagcctcaaaagttcttcctgcatttctcctttaattaaaggatcaagtgccgaaaaagcttcatccattaaaagaatatctggattaaccaccaatgcccttgctattccaactctttgtttcattcctccagaaagctcattaatatacttatattttgaatcttcaagccccacaagatttaatacctcaatagcacgttcttctctaatctttctggggatatgcttaacctcaagtccatatgtaacgtttcttagtacattcatatggggaaaaagtccaaaattttgaaaaaccattgcaaatttatcttttcttaaattagaaagatctttacgatttatagcattcatttccatattatttaccaaaatagatcctgaatctattttataaataccatttaaacacctgactaaagtagacttgccacagcccgacatacccataataactaaaatttcattttcataaacatcaagattaatattggcatttgcaataaaaatagaagattctttgtagatttgcattctatctttgccatcttcatagtcttttatagctcgacttatctgctttttgttaacataatacgaaaatactttataacaatctttaattttaacagcaaccctactcaaagcaaactcctcaataagcctgcattatgctttataacacatcattataaattatactaaaattattaaatttttgccgatctgaaataaaaaaacaaaagatcctttaaaggatcttttgttaatacaatttataccaattaaactagaattttatctaagcaatgacaaaacatattggggaacttgattagcctgcgcaatcattgccattgcagattgtgttaaaatactattagttgttgctgctacaacctcatctgtcattgtagcatcttttatttgagcataagatgcttttagattttcaattgcatactcagtactattctttatagattcaagtctattttggaaagcacctaaatttgccctttgatcacttatcattctaatagcattttcaattttagcaagtgatgtattagcatcaactgtagttgtaacattaacaggagaattaactccgccttgagaaggtgctgtagcaggtgctggctgttgagctccttcctgttgaacaccctcttgaaccggtgcagcctgagcagtttgagctccctcaccagagaaaagatttgcaacattagctgcataaatatttacagcaatagcttcatcttggtttgctccaacatgaactcttaaagtccaagacgcttgagaccctgaaagtgatgctggtgtgttaatttttgcaggctgcattccaagctcttcagctgttcttacattttgagaagcagatttgtttgataacatgtgcatttggttatattgagcttgatcagcaattctattaatttcgtctgtaagttgctctatttcaatttgtatagaacctctgtctgcatctgaatatgtgccgttacctgattgaactgccaattccttcattcttactaagactttttctacttcatttaaattcccttctgttgtctgaataaaattaatagcctttgaagtatttctagaagcttgtgacaaacctcttatttgagcattaatcttaccagaaactcccatgccagcagcatcatcagaagctcgattaattctgtacccactagaaagcttttcttgagttttactaagattagcagcgttaatgccattatttcttgaagcattaatagctgatgtattatgattgataatcatatatcattcctccatgataaaatttaaatttctgactttggcaaatccttttgcctgttaaaaagaatagcacaaaaattaaaaaaaaagaaacgcaaatagcaatagcattaaaaataattattattatttatttctttgattaaaatcaaaagcctttaatgtattttcttgatctttcatgcgcttaacggtaaaatccaaggtattaagttcaccttccacttttctctctctatcttcgtacttctttttataatcttcaactttatttttttgattaaaaattttcaagtcgtaattctttattttattataaataactcctccggaagccacaagaggcgacagacaatctcctagcattttagcaattccattatcatacactctgtcaccattaagatcatataaaaaaagctctctaacattatcaatattattacgaattgattcatcaaactttttctcatcaagtcttaaatatctagaaagtccaccagaagaagaaatggaatttgtaaaaactcccatctgattaattattgaaaaattaggatcactagtaacataaggcttaaaaattattgactctagcttggacttaagattttttaataaaaattcagaccttagaatacctaaatttttataagcctcttctttttgagaatcactaagataagttagctcttcaactatattagacttttgattattaggctgatcttcattagagcttacaatattaatctcagcaagaacctcattataagcaccaataaaatctaaaagaaccctcttaatcccctcataatcaggttcaattttagcctcaaccatatcacttgagggtttttttaaacttaatgtcacatttggaaccaaatcatttataacatttgaatctctctcaacatctactccatcaaatttaatttttgcattttcagcaaaacttttagcatttattggcaaatgaccatctctattttttggatcaaaaatttcaacattgctaatcacaattactttattatttgctttattttcaatatttatttcttccaaattagaaagagctccaacatcaacttcaacttcttcaaaattatttgaaatatttattaaaggaagctccaaagaaccttccttgctacatattttaaccatattcatttgaatatattttttttccaaaggggtttttaaatcagatccaagatcaactacactatcttcactctcaacttttgcatccttaaatgtagcccctccgggattaaaaataatcttactatcaggctcttccaagcctgtatcaaaatacttaacttcaaatttaatcttactcctagatgtaatttcaatatcttcaggaatttcaattgatacttctgaaagcggatttaaaacaagaccattgttctcaaaagcaagtttattgttgctgctagattgatttacaacaatatctgaaagattaggattaaaattggttttaagctcacttaaaattccaatttgcttagcaaaagacaatccctcccctttgataacaagcttgttttctttgccctcctttaaggattgcaaaacaaaacgactatttccatttttatcacttttcactatttttgcagataaaaagccctttcccttgttattaatatccttcacaagtaaatcaatgttgccattactttttacattaatttctttcttgccaactaaaaatatataatctccctctgggattgtaacttttttaggatcaaaatttgaagacaaaaacacatcagctgacgctatttgatcaacaattaatttatgagtctcattcttagatccatatctagtagacaaagttaaaacttcgctattactagaatttcctgacattagattaaaaggactgttgagtgatgtaagttcttttgcaagagaatttaaagtagagatttttctattaattaactgccaggcacttttctcttgctctaaagattcaagtttcttaaaagaagaatcaattttagccttatcggacttaagcatggattcacgaatttctttagtattgtacttactctcaagtccaggaacaaaaaatcctgatgccaaaatattgccctccggggtaaattatatcattaataaaattgaaaacaaaatataatgtataattaaaaaaataaaataaattttaaaaacatgaattcttaagcatccaaacactttaaaataaaaaatataagctttaaaaaagattaatgcttatagtaaaataaaataaataaaaggaaaataaaaaatgccaaatttttgcttatttaactcaaaatccgttttaactggaaatgataaaatagataactcagcggttctaattaaagataataaaatttttgatattgtaacgtctgacagacttaaaaaaatggatctcgaagaataccaaatgattgacacaaaaggcaattatataactcccggactttacgacaatcatattcatggatttcacggtcatgggacagaccagtgttcaacagaatcgatacttaaaatgtcagaacatttagcacaatacggtgtagtaggatttttaccaaccctttacccaagaccaatagatgaaatgattaaaacaataaaagcttgcatagcagcaattggtaaagaaaagggagctaaaattttgggacttcaccttgaaggaccatttttctctcctgaaaaaaaaggagctcatccagtttcttatcttcatgaacctagtattgaagttatgcaaaaactaatagatgcagctggtggagtatttacaggatcaaacggcaaaagaaaaacacatataagcacaatgactgttgctcctgagcttaagggtatgagagagcttgcaatattttgccttgaaaacaacataaaccttcaagcgggacacacaaatgcaacatatgaaaacatgatagaaggatttcaagttggaatacttcatacaacccattttttcaacgcaatgtcaaaacttgaccacagaaatccaaatgcaataggagcggtgttaatacacggcgatgtttcttgcgaaattattgcagatggccaccatatacacccaaaattaattttaatgcttagaaagcttaaagatataagtaaaatagtccttgtaactgacggacttactccgaattgtcaaacttgtggaaaactaattgcaaacggagacgaagtttatattgcagaagatggattattccatagcgtgaaaagcaacacaatagctggatcaacactcacaatgatacaaggtcttaaaaatttaatagaatttggtttcagcttaagcgatgctgttcaagcaagctcttacaatccaacaagaattctcaatattgataaaaagggcttaatatgtcatggatatgatgcaaacctcaatgtcctagataaagattttaatctaaagttaacaatgatagaatctaaaataatttttaacaatctctaactttaatcaattttaaggagatctcaatgagattaataatcagacccacatacgaagacatatcaaaatgggcggctaatcatgtagcacaaaaaattaatgaattttccccaacaaaagaaaatccatttatccttggacttccaacaggaagctctccgattggcatgtacaaaaacttaattgaattaaataaaaataaaaaaatttcatttcaaaatgtcataacttttaatatggatgaatacataggaattgaagaaaatcatcctgaaagttaccattcatttatgtggaacaattttttttcccacattgacattaaaaaagaaaacataaatatactaaacggaaatgcttcaaatctcaaaaaagaatgcgaagaatatgaaaaaaaaatcaaatctttcgggggaataatgctttttgtagggggaataggccccgatggtcacattgcttttaatgagccgggctcctccttaacatcaagaacaagaattaaaactttaacccaggatacaattattgctaattcaagattttttgaaggcgatgtaaacaaagttcccaaaaatgcactaactgttggaattggaacgatcatggattcacaagaagttttaataatagtaaatggacataacaaagcaagagcattaaagcatgccattgaaaaaggcgttaaccacatgtggacaattagtgcactccaactacataaaaatgcaatcatagtatctgacaaaaatgcaacttacgaattaaaagttggaacagtagaatactttaatgatatagaaagaaaaaactttaataatgacttaaaataaattgcttaaaattttaaagtaaaatactaaatatagaattgaaaatctttataaagtaaaggctaattaatcacttcattgtaaacttttgaaacttcttcccaatttaaagcctttaaaaatgcatcaacatattcaattcttctattttgatatttaaggtaataggcatgctcccaaacatcaatacctaaaatcggcttataagaattcatcaaaggactatcctgattaggcattgaaatcactttaaggccactctcaggacacaatactaaccatgcccaaccacttccaaaaattttcattgcagtatctttcaaattggccttaagaacgtctaggcttccaaaagctgcattaatatcatctttaaacttttcaaaaagattgtccttgtttcctggccttaaagttctaaaatataaagtatggttagaataaccaccagcattatttcttattaaagtttgaaattcttctggaaaatcatgaatattttttaatatgtttgacacatctgttaaatgaattttccccattttttccaaaatagaattcaaattcattacaaaaccattatgatgcttgctatgatgaatttccatagttttagcatcaatataaggctcaacagcatcataatcataaccaagttctggcagcttaaacataaaaacctcctgttttaacttttgccatgacaatttttatatttcttcccacttccacaataacaaggctcatttctgcctattttaggagaacttctaaccacttgaacattagaagcgcttttattctcattaataacaattccagaaagttctttatgaattggtttaacattcctagacttctttgttgacttaaaatcggaagaattgctatccaattttaattgaagaacacgccttatggtagaaactttaatatctttaataagctcgctaaatattgaaaatccctcttctttgtattctgtgattggatttttattggcataagaccttaaataaacagcctctcttaaagagtctaaatttgcaagatgttcctgaaatttaaaatcaatatttttcaaatattcatatcttaaaaatccattaaaaagatctctaccaatcaaattttccttttcatctaaatttgcttttgctatttgcattagcttagcctttaaatcaagagaactaatattttcaatagaaccaagactctcaagcatataagcaaaaattgaatttacttcatttaaaaaaacatttgaaaccgtgctactttttgtcccttcaagcaaaaaactaagatattcttctaaagcaacaagaatacgatccttaatagctgtatcttcaagaatggagtttctctgagcataaataaaatctctttgttttgtaataacatcgtcatactctaacaaatgctttctaatttcaaaatttctgtcttctactcgtttttgagcattaatcaaagatttagttaaaagagaatgtgtaataggctctcctgttgccattccaagcttacccattaatgatcttaggttgtccccagcaaaaaggcgcattaaatcgtcctcaagggacacataaaatcttgagcgcccagggtcaccttgtcttccactacgcccacgaagctgattgtctattcgccttgattcgtgacgctcactaccaataacataaagcccaccaagacttttaacctcattatagtctttcaggtaattttctctctcatttttaacagcctcttgaaattcttcaaggcttacattagttccgattttttttctaactctgtgctcaatatttcccccaagcttaatatccgtaccacgaccagccatatttgttgctattgtaaccgcatgttttgctccagcttcagcaataataaatgcttctcgagaatgattttttgcattaagaacttcatgcttaatccctctgtttttaaacatagctgataaaatctcagatttttcaatagaaacggttcccactaaaaccggttggccttttttgtaagttttgtaaacctcatctgtaatcgcattaaatttaaattcttccgtataataaatagtatcatcctcatctattcgcgctaacaatctatttgttggaactacaactacatcaagattatatattttatgaaattccttagcttctgtatcagctgtacctgtcatgccagaaattttatcaaacattctaaataaattttgaaaagtaatagttgccatagtcttattttcattagcaactctaactccttctttagcctcaatagcttggtgaagtccatctgaatatcttcgccctgttaaaactctcccagtaaattcatctacaatctcaaccccagaatcaccaacaatatactctctattttttaaaaaaagcaaatgtgcttttaaggcttgagtcatataatgaacataattaaaatttgaatcggtatacatagacccactaataatgcctttagaaactaaaagctgttcaagattattaagccctttggcagtaaaagaaattcttttggctttttcatcaacagtataatcaccatcaaggtcgtctatttctaaaggataatcacctgttttgggatccttggaacattcttttaaaaaagatacaagagaattaacttcaagataagcattggtgttgccttcagtaggccctgaaataatcaatggagttcttgcctcatcgatcaaaatagaatcaatttcatcaataatacaataattaaactttctcaaggatttttcattcaagtcataacgcatattatctcttagataatcaaatccaagttcattatttgtaacataagtaatatctttagcatattgagcctttcttagctcataatccatattagatagaacaacccccacgctaacacccaaaagatcaaaaaccggcttcatccaattggaatcacgttctgcaagatagtcattaacagtaacaataataaccccatctcctgttaaactatttaaatacgccgcttgaactgaggagagagtttttccttctcccgttttcatttctattattttgcctttgtgaagagcaagccccgcaatgatttgcacatcataaggcctttctttaagacgccttctagcagcttctctagacagagtaaaagctcgctctaaaatattctctaaagaattacccgattttaattcatctttaagcttttctgtctcctttgaaaaatcttcatctgccaacaataatgcccaacgctcaagcttattaatatttcttaaagtcggaagataatcttttaaatctcttttactttttgagccaatagttgtctcaagtactgcttttaacatggtaggtattaattctcctaaataattgacttaaagtcattttaaataataatataaaaatatgaaaaaacactataaagctcttatattaagcttgctttttgcaattatatcatgtaatactaaaactttaaacgaattaggagaagaacaatttaaaataccatttggaacacttcctggtgcaataatgcctctgaataacaaatttacaaattcaaaatttgacatcaaaacgtataacgggctagtgtacattgcagaaataaaaacaaataaattaatgattttcaactcatacggaaaactaatacaaacatatcaaaatggaatatttaaaacaaaccccgatttaaaaataaaaaaaatagattttgaaggaattcaagcaatatacccactaaaagattttattattgtcgcagacaaactaaataataaaaaatcaaaattcaaccaaaaagagaatattgcctacttcatgagaatactaatactaaacaaaaactcatctgtagaaattttgggtcaagaaggtttaaacggaatgccatttccacaaatttatgatgttaatgttgatgaaaatggcaacattgcaataatatcaatatatagcgaaggatatataatatattcttacaataaagaattttccccgctttataaaatttacgtcaacaaaaacctgttaaaaacaatagacaatcaaaagaaaaaatacaacatttcaatagataaggttttttttgaagtcaacaaaaaaactctttatgtaaaaactacttactatgaaaacattggtgacaatgaaaatataaacgatcttggaattaaaattaaagatcaatatatctataaaatgagtttgaaaaaaaacaaagaattagaagtgataaataaaattgctcttcctaaaaacttactagatgataaacaagaaagctttataaacattataaaaatacaaaaagacaaaataatagcatctactaatatgaaaaatttatctaacaatttaatatggaaattagacagcaagggctcaattaaagaacaaatagctttaattgagcctccaaatttaatgtttctctctgagagtttatctaaagatggaatacttagtatactttatggcggaaaaactggtgttagtgtttactggtggaatttaaatgcattattaaaattataattatagtagggttggatttgcaaatacaatgaaaaagattaattgcaatcaaaaactagaaatcgaataccaaaaaaaaatgaaaaaacatatcattattgggataatctttgttgcaattcttttattttttaaaattttattaattcccagaattcaaaatcacgaaaataataaaaataatatcaaaatgataataagctacaagcaagacaaaaacagattatcgctaaagataaacataaaaacaaaaaaaactaccaacctgggaaaagccaaactagatatttatctagacagtaaattaattgaaagcaatttgctttatataagcagcaaaaactttacaacatatgctaatataatctatcaaaatgaaagtttattaagtataatattaaagagtaatggcaataataatgtcttttatagtaaaagaataaaacctagaggtaaaatatgatacaaatatacttcatgtctgtttcacttaacatcttaggaggaataatacttgcatttccaatattaatagaaagaataagctttttcaaaatttttgaagattttgtaaatttaataaacgataataaaaaggtaaaaagcatttttggattattatttttaataaccagcgcccttgaaataatcaagccctacaaattgccaataattggaaatttaattccagctgtaagtttatttttaattggattcatcttgttcttaaaacaaaaattacctacagaagttcaaaataacaaaaaatatggaaaatttaaatcaatacttgaaagcaatcagcaaataattggaattatatcaatcactataggaataattcattttttagcagcagaaatacctttattgtaagatattgaaagattaaaaataaaaatgcaattttaaataaaaccaaaagcgacttgactttgacattagcattctatattattactatgatttaatgtaaattttaattaccgcctaaaaaaggctttaaatggtataaaggaagaagatctaatggtatttagaacatataaacatttggaactaataatgctgcccatgttaatgctgagttgcgctttttttaagaaaccacaatctgtacatcaagacagcaatactggcaaaccaataagcgatgaaaaattacatttaatatcaggcaaaatttcaaataaaaaattgccaatcataaatagtaatcatgacgtaacttggataaaaacaaaggcaatgacaatcttaggcgaagatggaaaagaaataccagaatttaaaaacaaatttggatattcttatataatatctcctgtaaaaatggatggaaaatatagttattacgcgtcattattaatactttttgaaacaactaaaaatggagatgatgaatatgaaattgaagatgttaaatttgtaacagctggttccaccctagaacttaaaaattctcttttagctgttgaaaattcacaagaagaaggatatgttactgcatacccatttggaatattgatgagtgacgagattaaaaatgcttttaaattaacatataaaaatggtcattggaattatatgcttgcagatttaactgtcaaaaataaacttactcaagaaactaaaatttataaaatttctcttaattcaaaattaattattgaatttttaaaagaagtgctaaaagaaaattctatattaaaagacatagctggagatttatttgaagatatataaataaaaacaaaaggaaatatcttatgagcattaaaaaatttattttaaccttgataattctttctctagctaaaaatagcttttctgaaaacgaaattaatatcttcgaaaacgaaaattatattgtaaaagaaaatataaaaacagaaattaaaaaactaaaacaaagttttttacttgcatctgttgatgtcgccattagccaaccctacatagaattggcagatttaaatggagaaccgataaaagaacttgaagggattagttattcatttataaatgtattttcaaaaattggatcttctgctattatttcatttgacctatcaaacgaagcttccaagaaatacaaaatcataaaattagaatttttaagtccagataaaggcaattttattaaccagctaagcagccttactagtggaaaacagcaatcaaaaaaagagcttgcaaaagacgcttactcatttggtacattaagaactgaatctctttcaaaaacaattgcagaatattacaaagataacaactggtattatattttagcagcaataacagtagaaaataatataaataaagaaactgaaaaatacgaaattagaattaaccctaaaatatataatgattttcaaaaaaaattgagattacattttaaaagcaaccaaataaaaaaatttccaatacccattatagaataaactacaaattaatagaaaaaagatttttacttctctaagagagctaaatgtataataataaaacaatgggtagtaacaaaacaataataataaatttaaataatttagaacataacttaaatttaattaaaaataaaattggcgaaaaagaaatagtggccaccttaaaaggtgacgcatatggtcacggacttataaacatctttaaatttttaaaatcaaaaaacataaattattttggactttctaatattgaagatgctaaaacacttaaaaaaattgataaaaatataaaaatattaatgtacattaaggtggataaaaaagaaattaaaaatttgattaaatttgagttagtaccatttgtttctgattttgaatatctatttttaatagaaaaagaatgcgcattgcaaaaaaataaaataaaagtccacttaaaaattgatatcggaatgaatagatatggaataaaaatagatgatgcccttgaaatagctacatatattcaaaattcaaaatttctagaactagaagggatctgctcacatctcccatcaatagaaaactttaaaaccacacaaaagcaaatagagcaattcttattttttttagaaacactaaaacaaaaaaatattcatcccaaatttgtccatatttctaattcagggcacattattaactacaaactaaatccacaatttaatatggtaagaccaggtcttattctttacggttactgtcaatcgctaaaaaacaaaaaacctgctttaaattttaagcctgtattaagtttattttcaaaagtaatatttatcaaaaatgtcaaaaagggtgaaaaaatttcatattcgggtatatttcaagccaaagaagatatgaaaataggaattattccaatcggatattttgatggaatacctcaaaatataagtaatgatttttattttttaataaacaataaaaaatgtaaaataagaggaaaagtttgcatgaatctgacaatagtagaaattcccaaagacctaaaagttaaaacaggttcaaaagtagaaattgtatcagaaaaattaagtatagatgaaatgagtaaattttctaaaagaagtcattatgaattactatgtaatataggaaaatacgaaaagagaaaatacttagattaaattacccaaagaatcaaatttttgaaaatctattaaattgcctctagaatcataaatccacttataaattgaaaatcctccaacatcatctcttaatctcaaatccggaccatgattagactgctttgatatttttccaaatttattatattcatatttataaacactaactccatgaatatcatcctgcaactgtcccaagctgccaaaatttttttgagaaataagcctattttgtttatcatattcatataaatactcaaaaacaaaattacaatcagcaaccaaaactccatccttagaataatttttctttgaaatcatattgccattagaatcgtaactaaatttatactttgaaactccttcaaaatcatctattggattaacaaaatccccaccaaaatgctcttgagcaatcaaaaatccttctttgtcgtaagagtatctataaatcatcacgcctttaacatcagctattaaattaaaatttttatcaaaaaaaatattttctattagataaaaattatcatcatatttataactataaatagcaatacctttaaaattatccattatttcatacttttcctcataaacagtaggaatatctctattatagtttttattgatcttattactgtagtttattattcttttttcattattttggatataaaaaatagtcttcttcatggcatacccattttgactgattgttaaattattattattgtcgtaattatattccttgtaatagcaatctttatctttaaaataatattcataacgataaattgctacattattttcatcaggagtcaagttgttattaatatcataatttaaaatctcaataacttttccatcaacatcataatgatatattttagtagctacagaaaatggatttgaaacagcataagccgatttatcaagatattcctctttaataagattatgattagcatcataagttaatctaaacccaaaagtaccattttttgatcttacgatataaccattctcatcgtaatacaaaaccgttttaacaaatttggtatgatcgtagctgatctttgtaaaatacacattatttaaatctttgatttgaatccctgattcattaaatctgtaaacactaaactctctctcattgtcgtataaaaaatgataataagaaacatcatatttatctctaaccatttcattagatctattataattaaaaatatttttaatcctgccatcactcatatactctatatgttcaatataaacaccattattgtttttaaaagcaagtcccctatttagaaatatgcgcctttcgctgcgcttggacctttctattttaatttggcttgcattaaaaaaagaaggcattaaaatactaagcttaccaatataatcaactaaaataagattattattgcgatcataagtaaatttatatccgtactcttcctcagactcttcttttgtaatctcatatttacccactatactgtaattaacagaataatctgcaaacctatagtaaacttcttttgaaaaaagaggagcactaataaaaaatattataaataacatgaataaattccttgataaatcaaccctattttgatagattttattatacaataaatctatcaaaaggagctttaaaatggctaaaatttctaaaaacgctcaaagagtgggttcaaaagaactaataagtcgatggggaggaaaaattataatgaaatcaaaatttgaaaatgggaaaataaagcattatgcagaatgtcaaacttcaaaaaatacagcaagaaagccaagggatttattttaacaaataaatccgcttacttacaaacgctattttttttgtatcctatcactaaatttgacccaagcttcatcttgctcttgttttgtatagctcttacttgccacttgcttaggtgctgcgcccttcttggggaaagaatttctaacttgctcttttatttcctctctttgttttctaattttttccaattgtcttttaactctttcatttgaatcaaaaagaccgcttccacttttattcaaaccagctctaaaatccaatctggacaaagcctctttataactttgatgcttgcctgtcaaaaacaaaacaattcttttaaacaagcttaaatctttataagcagcatttaaaatcgaatacaaatcaagtttatatattttatataagggtaacaattcattactattcttaaaatattttgctgcttcaactttaatcaaatctttaagatgaacctgaacgctttgtgttttacaaattctcctgtaatgagaaacaataagatcaagaaacttaactttattttttaaacaatactcattcataatatatctagataccaatctacttagaacttcttctaagccttcttctgtaaaaatagaagaaggatcatccccaaagctaagaattttaaatatactagccctcaattcactattaagaaatttcaaaaccttttcatattcttctaaaaaaaactcatatgcaaaaggcttgtacaaataaaaattttcttttacttgaaatatttttggcaaaatatcatgaattttagattcaaaaaagtacatattagcaactaataaaaaattttcaggatcgtttagcccttcagaataaacttttaaaatcccaaaaaactcttctgtatcaattgagccttttttaaactctaaagtcttttcaattgcttttaaagattcatcaattttaacagcttctatagccttaagctcttctaagtctttttcatttttaataaaaagattaagaaactctaaaaaaacaaaataattttttgaaaaagtaattccttttttgccaagaacttcatccttgatttcaattataccagagagaatcttggaaatagcaccaataatattcttaccctcttctaaagttttctcataatcaataagctttaatccttttattctaacgaaaacatcttttacaacattattagaagcaatattaaaaaatatttttttaacaaactcaataaaatataaagccctgctcgatggaattatcaatgatttccaaactaatatttctttcaattgtgattttgtttcaaaaaatttatagttaatatctgaatctgcaatagttataaattcattcttaaaaaccaacaaactagattctatattcttaacagtaagcaaagaactaaaaagctctattcctatataagttttcaaaaataaatcatcaatagaataataataaaaatcataactggcctcatcggtcaaaattatactgtctggcaaaaattctccatcagttgctattctattagtaactattcctcttttaacttcataaagtttgcgaaataaaaaatcaagctccccttttaaacctcttatttttacagaatgctcttctataaaagaagaataatctatagcttcctttttataagacaaaagagtttttaaaattgatttttgggtatcagaagatattcctaattgagaaatcaaaatatctacttctttgctactcatataaaaaatttctggtaattttttcatattgttccttatgttacatttaaataataaaacatattacattaaaaatatattaacaagtcaaaattaagatcaaataatcaataaaagttaaataacattaaattatataaaaaatataaaagcaaaaaaattaaagaaatgcccctaccaaaaacccctttaaatttaaccactaaaaataaaactaaagttataaacaccattatactaaaatctaaaatataaatatcttgcaataagataggtctgaaaaaactactactagctaaaataaatccgatattaaaaatattactaccaataatgttgccaaatgcaatgtctgattcttttctaattattgcaaaaagagatacaacaagctcgggaacacttgtcccaaaagctacaagtataattccaatcaacttttcactaacattaaaaacattgttggcaatgtaaagagctccatctaccaataatttcgatcccaaataaagaaaatacatgctaatagcaaaacttaacaagttaaaaaatataaagttaaaactctgatttaaattacttgcaccttcttggaaagaattttctaagctggcatactctttttcttctttataaaaaagcaacaaataggataaaaataaaattaaaatactaaatgagctaaaacgattataaggtgttacaaaaaaagagtaagatctaaaatcaaatgaaagcaataaaagaagaaacattaataaaaacagaaacataaaagaaagcttaagtcttttaaaatctgccttaatctttaaaaagaatcctgctaaaggcagagcaagcaacatattaataatattgctaccaataacattagaaacaacaatttcgtttttacccttaaaagctgccaccaaacttgtaaaaagctctggagcacttgttgaaaaagatactattgtaactcctattaaaagtgttggaacttttaaataagtagcaatgccaactgaactttttaaaagtaaattaccaccaagatacaataaaaaaatcccaaatcctacgtaaaaaaattgaattaaatgttgcaaataaatctcctttacaagaaacaacaattaaaaagaatctaaatattcttttaaactacctttaatcatataataaacattagatgcattccaaaggctaaagccactaccaaatgactctttaattcctttaagctgaaactttaaatactccaaataaatctcgtcatccaccaatctttcttttcctaataaaaaagcttgaacataaggcctaataacaaccccatctaaagaaaaagcaagtgctctatcactcccctctttataaatcctataagctctttttgtgtaataaaaattgcttggcaaaaaatcatcagtataatgcgaaggataaaacataggagatatgacgtcaacataatctgataacattgaaatattttgcccaatactattagtaggaaaccagccattgtacccataaatatcaacagaaataggaacataaagctgttctcttgccataatcaaaaaagattcaagtgcatcaacgggttgcatctcatacttattcattcttgagattgcaagagacacaggcccatctgatggaaatctaatataatcaaattgtatctcgtcaactccaaaagattgaatttcttttgcgatagaaatattatattcccaagtagcaggagaaaaaatatctacccaatgctctacttgtacatatttcacaagaccactagaatcaacttttttaatcaaatgagcccaaggtttattggtttttttattccaaagggcgtgtttaaaattatcataataatacaattttgaatctttaaatacaacacatctagcaataacataaattccaagctcttttgcttttttaagaatataaggaacatcaataaagtttttaacagatctcaacttattgggcaaagaaagcttgctagaataagtcaaattaccattatcatctttaaaatcaattacaacagcattcatacctgaatctttaataaatttaaatctttcatcaactgccttcttattacgcaatgtatatgctgttaaataaatagaccctttatttttagcaagctgcatcctttgtgatttttcaaaaaaatcctgatcctgcaaagataattttccaataaatacccattgcccattaatataagaataaaaatgattgtcatatgttctgactaaaattttttctacattcttactagataagtctaaaatacgtattatttgctttttgaaaggaaaagatatttttttaataaatccacttttctgactaattaaaaaaatatctccataaactccagaggaaaaatataaattatttgtctcttcttttgaaaattcaatagcactaataatatcgtaatatcctgcacctaaataaatctgcggaatcaaacgatttaaatttttaaaactaatagctccattaacactaagataaataccatgaatcgcagttccaatagcaatacgcttgtaatctccttgagaaaaggcactagatgtaatatatgcaccgctattaaatttatcaattcctactaattttctaaaattttttgaataatcataagaaacataaagattgttacttgtagtcaaaaatgaacttgaagaataaacatcctcataaatagaagtaattcgactaggaacaagcttataaaaagggtaaacccacctagaatttatcccattgacttgaactttggttattttcccattaacatttttacttaaaaatcctttatgaacaaaaaataaactatattttttaaaaaattcttcatcggttaatgaatatatactaaaaaccttgaaaacagaaaagaagaaaataactacccaatagataaaaattttcatatacattaatacatgatacttgcaaatgaaaaaatattaaataacagtgatttttatttgcacaattagatctcaattaaatttaaaaatacctaaattttataacgactttgctcttaaaaatcttaagccctgccataaagccttgtaataaaacttatattttgactcaaagtagcatctaaatcactttctaataatctaaaaatacaattatctaaagtgctttttgggatatttgcactaaatttatctcctaaattaatataatcttgcattgacactatcacattatcagaaacactacccatagcacttcttatcatgtcccaaacaacaaaattttcatttgtatttaaataatcaaaaatgtactttttatgcaaatcatctaaagaattaataaactctcgtattgtatcattatcaccacttcctgtgtaaactatgcaatttttaatataattatgaggaagattttgattgcttgaatcaaaatcaaaggcaagattcattattttcattcctggaaaattaaaaaaatctcttagtcttgaaacatcttcaagatcattttgaaaatcttcaacccaaatttttaaatctttaatttcatttaaaataaaattgaaaaaatctcgtcctggcgactttacccacaacccattaaaagcataagactcgcccgcactaacttcccaagtagaaacaaaacctctgaaatgatcaattttaattatatctgcatactttcttaaaaccccaatcctttttgcccaccattcatacttaaatttctttaaaacattccagctataagctgcactatcccaagcttgctcttgttctaaaaaataatctggagaaattcctgcaatcttatctttgcttgcatcaaatcttagcttaaaatatttttggtatgcccaaacatcagcagagtcatatgctataaaaaaaggcacgttcataattagctcaatccccttatcatttgcatagcgctttaaagcttgaaactgtgaaaaaaagaaatactgcaatacctcttgcactttaatctcttttgaaaggatatttctcaatttaaataaatctttttcatttcttttaagaattcctctatcaaaaagaacattaaaagcattctttgactctttaaaaaaatattctttaaacgcaacaaaacttgcaaaatctaaaagccaataagaagacttttttttaaatttttcaaagcttctaacctcatcagccgaagctctattaataaaatttaaagcggcttctttaagaaatttatctttaaaacttattttttttaaatcagaatacctggtttcattttcttttaaaagacttaaatctgaatctataaatttgtcaagggcttctaaatcaatataataaacattgccagcaaaagccgaaaaaattgaataagggggagatcttgtaaaatcaataggggaataagcaaacatttgccaataactttgagaagatgcaaacaaaaaatctataaatttataagctcctttccctaaatctccaatgccatatttagatggtaaagagcttatgttaagcaaaataccactttttctttttaagtttaaattaatccttgtttttttatatttcatataaaacctctattaattaataatttaaataaattcccactgtgttataaattataataaatatcagatcagaacaacatattaaatagcaattttaaaaaaaattagaaattaaatacttttatgataaaatctattaatgaataccaaggcgactacaccattgttgttattatttttaattcaaagcttagctttttcttctgaaatctttgaatttaaatacattaaaggttcaaagtttagattagaaggcacagataatcaaaaaatatatttcaatggccattataattcaagctctaataccaatattcaaatttcaagtgaaataaaagacataaaagaaaactttgcaagcattaaagctttttttagaatcttaaaaagagaaaatattaatgaaccttacctattaaatgaagagtttgaagaaatcttcagcgtaaataagcaaggagaatatacaataggagcaaatcaaaaaagaccttctgttagaggtattccaagattcccaaaaacaccaatcaaaataaatgaaaaatggtcatatcttgcagaagaatatatagaagcgtcaaaaatagacaaaagtataaaagatttcgttgtaaaatttaatgttaactacgaatataaaggcaaagaagagcacaatggcaagcattaccacataattctttcgaattatgaatcacaatacaatgtaaaaaacatctctttctatcaaaaagtagaccaaaaaatttattttgataatgaaattggcaatacatataaatacagcgataaatatatatttgaaataaatcagaacaacaaccaacattttaaaatgattggaaactctcttggcagaatagtttcaattgagcttccaaatgataatcttattgaaactgaggttgaaaattacatccgagaaaaaaaaataaaagctattgaagttgaaaaaaacaataaaggtattaatttaagctttgacattgaattttatcctaactcatttcaaatactacaaaaagaatataaaaaaattgaccttatagctaaacttcttgaaaaatttaaaaaaaataacatactaatagaaggacatactgagcaatttggattggaagaagagatgcacgagctatctgaaaaaagagctcgtgcaattggaaattatttaataaaaatgaaagtaaaagacaaagaccaaatactatttaaaggatggggatctcaaaaaccaaaatatcctaagtcctccccattaaaggctaaaaataggcgagtagaaattacaatattaaataactaacttaagatgtatcatcttttgttctttttttctttttttgtctgacaactaatacacaaaaaagcataaggaatagctaaaagtctctccctagcaatctctctttcacaagccaaacacttaccataagaattttgagaaattctataaagagcttgatttattaaattcaactttctcttttcaacaaaacctaacgcttcaagattatttccatccatattatcaaaagcaatatcgacaacatcctttggatacatgtcattattaattatttcttttttgctattttctacagacttaatagaatctaatatctctcttttttcagctgaaagaaattttttgatctcttcaataaactcatgctcagaaacagctttttgcatgatacctccctataaattacatttttaaaaaacttcgtgtaattatatacacaatttcttataatgtaaacaaaaaataatgcttttattcttaaaaagaataattgaaatgatatgtttaatcatgtaaaatttatcctattagagaaaattatggaggttgtcttgaatattaaagaagaagctattgaaactgaaggaattgtaaaagaatcccttccaaataccatgtttagagtagagcttaaaaacaagcacattgtacttgcccatctatctggcaagatgcgaaaacatttcataaaaatagttcctggtgataaagtaaaagttgagctatctccttatgatcttacaaaaggtagaatagtgtacagggaaaaataaaattaaacccttttaaaaaattttcaagtgttgtaaatatttattttttagatcaaatcatcttttaaggacacaacaaaattcttgtgaatccagccttgaagtccataacttgtttcaataagaacaaaatcatctttgctgtcaagaatataaacacttgcatttccttttaaaaatctccaactccttgaaaaattgtcaggaactttataaagagagactaaatcacccttaattattcctacttcagattgttgctcataataaaaataatatgtttcaaatatagtaaaacaaaccgcagaaaaaagtaaaaatataattatttttttcaaattttttgccaaaaatctataagaaatagatacaactaaaaaattaatcaaaaataaactgataataaaaaaaatattagaaaaaataaaactattgttacgaacattgtctgtaactccatttttagcttcaatcaaatcaataactttataagaggtttcattattcggagaagccaaaaatgccttataagctgaataaatagcatcaaaatctctatccattttacttaaaacaagggctctatttaaccaaagtcctgaataatttggatattttttaagaatgttatctatcttgataagtgcagcatcataatttttagtattatagtcttcaatcaaatcatttacatttttctccgacaataaaccatcatttacagcatttaaactaatgccaacagccaatattaaaataaccagcccaaaacttgatgctgcaaaaaattttttatagttaattaaaataattaaagataataaaaatcctggaatcaaaagtaaataatagtatgaaacaaaaaataaaaaagttttatttttataattcaaaatatcggcataagataatagtttaaaatcagaatctacattattttgtgctctatttatgctgttaaactctcctgaatattcatacttcaattttttccctttaagggtataaactgtatcattatcaggatttaaataattaaaatcaccaatatttaaaaatacactacctttagtgtcgggcttaactgtataaatttgagaaatactacccttatatccatttttagaaggcttaaagctataatttttctttttattaagaattttagaattataagtttcaatctctggaaagtaaaaatgtggaaaattcccttgacctgtaatttttattaaaatagtaaatatatcttgctcaattgtcgaataagttggagtctcataatcaactctaaaagttcctactgctaaagatttaacctctccaggaatcggtttaacttttaataaaagctcaggggtattcctaacaaggccagaaccaatattaaaagaaaaactgggaatcaaaacattttttgagcccttaagaggagttagtataaagttataaaaaggtacatctaaaatctctttattatgaaaagttctatatttaatatccccaaatataggcatcttttcaaccattgcatccttaatagcaggcaaagatccagacatttcattagaattgctatctgaaagccaatttgagcgcaaaataagtccaatactttgatattcataaatttctttcttatcaagatcccaatataaatcaactggcaaaccaaaagaatttatttcatcagctcttagcacactaacttcaacttctgaagatatataaaaatcgcccttataaattacttttaatggaggaattttaataaatcccaaactctcaaaaagatattcaaccctgatctcaataaaagaaaagttattatcggttgttctagatattgataaaacattggaattggattgaacttctttgtttatttcaacttttagcaaacttatgtcaatatcttgcaaaggattattaagtcttacaatctgaataaatttatcgccctttaaaactttaatatttttaacaaaatcaatgcccgtaagcgaataaagtcttgcgattgaaaaaaaataaataaaaaatattaccaatcttcttttggaacagctagattctcgtctatttttctcaaccatacaaccctctcaagattttcaatataccttaaaaaattttcattactttcaacaaaatttttacctttttctacacttaaggaattcaaactatcgcgcaccgctcgtttttttattattgcaagttcaagattatatttagcattataactgccaggattaatctttaaagcttctttgaaagccacctcggccttatgatacagtccttgattatagtatattactccttcgttataattgacattaaaatttaaaaaaatatcattggtcttcttagcgtaagagaatattctaagagaactttcatactcacccaaagaataatatacaacaccaagattgtaatatccccaagcagaatatttttcatcctctacaagattataataatttgaaattgcattttgataatttcctctaacatattcgtaattaccaatagccattaaagacatggatttaacatttgagcaagacaaaaaacctaaaaacaaaaagcaaaaatataaaattgctaaaaagtttcgtcccactttatcatcctgacaaacaaatacataaaaataaacaacaatgaaataaccaaaaaaattttatatcttgatacatcaacaagtataatgtcgtttgacgttcttcttattataccatttcttatatcattgacaacaaagttaatcccttttaaatacaagttataatatgatcccttaagagaagaggccagaagaagtaaattttcctcatttatcccagttttaacaagatttccatttttatctttaatgcttaaattttgattaaataaaacgggattactcccgccaatcccaaccacaaaactttccaattttaaattattgacaaatttagaaaacctataataattattttccccccaatcatcgccatctgttaaaataactaaaaaattataatacgagtcatccggcacattagagattacactaaaaacagcatctcctaaaaaacttccaggagagcttattaaatcaggctctatataatttaacatcttgtttaaactgtttttatccttagaaaaaggtaaaactaatttagacttgcctttaaaaatagtaagggaatattctgcattctcaaaattacttaaaattaaactaatcatatttttagcactctcaagtctattaataattttaccttcatctacacttaacatgctacgagaaatatcaaaaataaaagaaattctcaatttatttctctcatcctcaacagctctttgcccccaagaaatatccaaaatggataaaattaaaaaaatcaagctaaaaataaaaaacattgacattagaacttttttaatgtagtaattttgaatataagaattgtccccatacataaaacttaaggttttaaaaaacggaatatttcgtctaaaatcaagcacacatacaaaaaaaataaacaataaaactaaaaaaaagtataaagcactataattatttatactcatagtatctcttttaagaaaatttttgaaaaaataaaataaacaagcaataagcaaaacgctaaaactaaaaattctttataaatatctttattgtccacagctattttaatttttctctccaaattttccttttttgaaaaatcttgaattgcaaattgaaaagaaaaatcatcattaaccgaataaaaaagcccccccgttttatttgaaatctccacaagcatactaggatcataaacctctttaaaacttccctgataaaattttccagatcttaatttaaactcaacactaaattcttcagaacttccaataccaatagaataaatcttaacatttaaaccttgagcaagattgatcacttgatctttatraatctcatctgaattaacaaccccatctgttaaaaccactattgatcttttaagagcctcagaatgctttaaatgagacagcgcaatagaaatacctagccctaaagcagaaccattgccaagatccataatataaatatcatctagctttttattaaaaaattccctatctgttgttataggcactactattgaagcatcttttgcaaaagctaccaaaccaatattatcattttcacgttgagaaataaaacctctaatcaattcttttgaaaattcaagtctatttttggaagaaaactcaacagcccccatactaggcgatatgtcaagaacaatgacaatgtcagcaccagcactaagatgtatcatcttcttttttgaaactgaaggacctgctaaagcaaacaccataaccattgcagctaaatataaaaaagagtaagtaaaaaaatacatcaaatttaatctataatccttaagttttaaagagttgaaattgccgtaaagcgatattggaaactttatcttgcctcctctattttttaaaaaatgattaaagtaaattattaaaggaaaaattactaataaaaacaaatataaaggctcattaaatgttaacattagcacctctattaaattcttcaaaattcgatgctgccgttcttaaatcctctaaaacaaacgacaagctatcaaataccaaatcaacaccactaaatttactaaaatcagaaagtcttaacgtattaataaaaattgatcgaatctcgtaaggaaccttaagatcttgcaaaattatagaaatttctgttgtagtgattgcattaaaatcaaaacctgtttttttagataaataaactcttaaagaagaatttattaaattataaaatgcactttgatccccaccatctctaacgtatttagacaaaataacaaactgcctctgcaatactttataaggctttttaagtccgtgcttaactatcaagtaaatcaaaagccgatttaaaagctttaaaagcttaataaccaaataaggaatcaaaaacaaaacaaaaatgaataaaaacaaataggtgcttgttccaggaataaataaaacaccttctatatttttaattttaaaatcagaattattagatactagcttatctgtattgatttttatattctttagaataaccttgtttttcttaccattgctaattacatcaccaatataaatagagggaagagagctgcttccaatataaaaagaaacaaaattaactattatttcatttgttgtgttattaaaactaatcgaatttacttcaacaaattcatctttaatattaatatctttaaaatctacaggggaaaactcttcaccatcatttaaaattaatgaaactttaaaatcaacagaatcacctacataataacgagtcggcataaatatttcattttttatttcataagaatacaaagataaggttaaaaaaagaaaaagatttgaaacagctctcttcaaaatctattgtccctttttaagaagaattttaagttttttaaaaacatcttctttagtatcaatctcaataaaactaatattttttttaatacattcttttttccattttattttatcaagcgtccaatagtttttataaccacttaatgttgacttgctaaaccccgaaactaaaaaattttctccagtttcaatatcttcacaaattaaagtcccaattttaggaaaattttcatcaaaaaaatctgaaattcttatagcaataacattgtgtctcttgcttaaaacatttaaagatttaaaataagcattcgccttaaaatcagaaataattataactaaagatctttttttataatattctgccgtatttttaaaaatataggccaagctgctacccggcttaagatttctattaattgtttcacttaatatcaatcctaagtgtgaatgacctttgctagagggtataaacttgtctgttccacttgaaaaaaaagtaacacctattttatcattattaaaaaatgccatatgtgcaaaaatagaaaccaacaaatcctgaacatcctttttgtttaccttgtctcccaagctcatggaaagtgaattatcaacaagaagatgaagattcattcccctatcctctttgaaaacctttgaaaaaatgctgtcggcttttgagctcacattccaatcaataaatctagcatcatcagaatcctcatacggcctaaactcatgaaattcaaggccaagacctttaaaaattgaacgataaccaccaaaattaagctctgaaagcattttccttgaaaagaattttaaagcttttatcctagttttagtactactacttatctcattatcttgtatcattttaaaatcatttcctaaggaagcgctacagcagaaagaagcattctaataatatcatcaatgctcatttcctctacctctgcctcataagatggtgtaattctatgccttaatacgctgtaagcaacagctttgacatcttctggtaaaacaaatattctcccctcataaagagcattaacacgagcacactttaataaactaagagaagctctaggagatgctccaaattcaatatatttggcaaacggataagtttttttatccctttcacgagatgccgagattaaagtaacaatataaagcattatcttgtcatcaacttttactctaccaaccgttctcttgatatcagccaaagaataagcattcatcacctttgcaactttaatattctcaagacgcccatctactgaaaatattttcaaaagccttacctcatcttgcactgatggataatgaacattaacttttaataaaaatctatcaagttgggattctggcaaattataagtcccctcttgctctattggattttgagtggcaagaacaaaaaacggatctggaagcctatgagtttcgtctccaagagttacttgtctttctcccatagcctcaagaagagcagactgaacttttgcaggagccctgttgatttcatctgctaaaataacatttgaaaatactggaccttttctaactttaaaagtgcctgtagcacttttataaaccatattaccagtaaggtcagatggcaaaagatctggggtaaactgtatgcgcttaaattcaagatcaagaacatcagatacagtttgaattgcaagagtcttggcaagacccggaaccccttcaagtaaaacatgcccatctgttaaaagacccattaaaatagcatctatcatttctttttgaccaagaactctggttgcaacctctcttctaaatttatttatcaaatgtaatgcattctctacttctgaatctatctgaaaaccactcttcataatactcctagtcaaaatcactctaaaatataaactgaacttaaacgataataatattatctgtaaagcaaaaccaaatttctatctactcttaattttgaatttaaagactttacttctattttactaaataaatttttaatttgattgacttcaaggttaattctatcaaatttacccttatatgccataatcaatcccccaccctttaaaagattttttaaaattaatgcatattcattcatatttctaaaagctcgaattgtaataaattcatacttctttttttctttttcaatctcatattctaaaatttttacattttctaaatcaagttctaattttatcatttttaaaaaagtagacttttttttacttctctctaaaagataatattttctagaagagtcaaaaatagccaaaataatgcccggaaatccagcaccacttccaacgtcaagaacttcagaaggattaatctctttaacagtagacaatcccaaaagagaatctataacgtgtagattaagaatagaattaaaattgctattactatttgaaattaaattaaatctagtatttaaaagtaaaattctctttatatataaatttatcttctgaagatctttgtaagcaaactgaaaattatgttctgacaaagcaaattcaatatcacttatcataaagaaaaatttataactaccttatttttaggatttgaaaaatatattaacaaaacagtaatatctgtacttcttattccaggaattcgacttgcttgagcaagggtagctggttgaatcttagaaaatttttctctagcttctcttgaaaggccttcaataatttcataattaaaatcaaatggtagcttgacaagctctagattatcaagccttttaattaaatccttttgtctattaatatagccttcatatttaacatctaattcaacttgctctaaaattacttttgaatcacttaaacttggatcaatctttataagattatctaaactaatagaaggatcttttaaaatatggtaaaaatctttactaacatgtttttttaattgttcatcaacaacatcttttaaactaaggcgcctttgctttaaaagctcctttatctcttcaaccctgctctctttaaaaagatatcttgaatacctcttctcatcaacaagcccaagatcatatccaatcttaatcaaacgcttgtcactagtatcatgccttaaattaagtctgtgctcagctctagaggtaaacattctgtaaggttctttagtgcctttggtaacaagatcgtcaataagaactccaatataagagctagttcttgttaaaatcattggctttttattttgaagtcttagagcagcattaattccagccattaacccttgagctgctgcttcttcataccctgaagagccattagtctgccccgctataaaaagccctttgactcttttgctctcaagatttgggtaaagttcaattggatttatataatcatactcaacagcataaccgggccttgtaataacagcatgctcaaggccttcaatgctgttaatcaatttttgctgaatattttcaggcaaagaagagctaagaccattaagatacatttcttcagtattaaaaccttcaggctcaataaaaatttgatgcctatctttatctttaaattttactattttatcctcaatagaaggacaatatcttggaccattacccacaatctcaccagaataaagaggtgataggtgcatattctcgctaattatttcgtgagtttttttattagtataggttacataacatgaaagttgagatttatctaacttgccatttgaaaaagagaaaggaataatatctgaatctccaaattgaacctccgtctttgaaaaatccacactttttttatgaattcttgctggagtgcccgttttaagcctacccatttcaaatccaagaccaagtaaagttttatcaagcccataagcagaaaattcagcaagcctacccatatcagctctatactcgccaataaatattttacctcgaagaaacgtccctgttgtaagtaccacaacgcttgatctaaacttattgcctctctctgtaacaacaccttcaatttcatttctcattgaattaagaagaaaatccacaactgtatcctgaaaaagatcaagattgtcttgacgttctaaagtttctttagccttggtttggtacattaatttatcagcttgagcacgtggagcttgaactgctgggccacgacttttgtttaaaactctaaactgaatcatgctaaagtcaataatacgacccatttcaccaccaagagcatcaatttctctaaccatattacccttagcaagcccaccaatagcaggattacaagaaagcttgcctattgtatctaaattttgagtaatcattaaagttttaaaattcaaccttgaaagagcaagagcagcttcaatccccgcatgcccccctccaataacaattgcgtcaaaatccatatttatttccccaaacaaaaattcttaaacatattgtcaagaacatcttcactactaacttctcctgttatttcccctaaacagttgataatctcataagcatcaaatgctaacatatcataacttacttggcgatcaattttactaagtaaatctaaaatcaaagcataagctttctccaaaagttgcatctgacgatttgatgatattattatatcatcaagtccaatctcgactctctcataagagattaaagcccttattttgtcataaagaatatctattccttctaaatttttagtactaatcattattaaatttgaagaatttaaaacctttgagcgaacaaattcttcagtggacttatttatctttaaatctatcttatttaaaacaaacaatattttactattagatttatttgaatcaataaataagaaatcatcttttgttaaatttgaactaacatcgatcacataaatcactaaagatgcttcctttattaaagagttacttttctcaattcccaatctctcaacaaaattgtcagcatctcttagtcctgctgtatcaaaaagattaaataaaataccatcaagctcaaaacttgcctcaatataatctcttgtagtgcctggatatgaagaaacaattgatctatcttttttgagaaataaattaaataacgacgactttccagcattaacagaacctgctaaaaccaaagcaacaccattatcaattttttcataaaccttataagaattaattaattttttaagttcagccttgctacttaaaattaagtcaaaaggaatactaatctcatgatcatcaacctcataatcaagataaacactaacagctgatagaaaatttaaaatacttttttttattgcatctattttaacaaacaaagctccagaaagtttattaactgcaagagaataagttttattggttttggcaaaaataatctcatgaattgcctctgcctttgtaagatcaatttttttagcaagaaatgcacgtaaagtaaattcaccaggttcagccatcctaaacccactttttaaaaacaaatctataatctttttaattccaatcacagaaccatgcgccataacttcaatagcatcttgccctgtaaagctttttggtgctcgatataaacaaacaacaacttcatctaccttgcaaccattctcactatctaatatataaccgtaatgaatcgtattcccagatgctgaattgagagctgaatgatttgaaaagattttagaaaatttagatatagaagaagcaccactgctacgaatcacacataaagcactacttaaaaaaggtgttgcaagagctacaatatcatcatctctctcaaaaaacttactcatactttaatgtattataacacaataaaaaagacaaaattgatttgtaaatatgtttataatagcttataattaatttcataaaaatgaaaacaaaacttgaaactgaactaaaagaagtcttaaaaaaagaacttctcttggtagaagaaatatataattcatacttaaaaataaaagaatatatcgacaataaaaatgaaataggacttaaagaggtcgcaaacaaaacaaaaatattgcttgaaagttttaaagaaattgaaagcaaaagagatgaaatttggaaaaaatttaccaaaaatgaaaactttaagtcaacttacgaagctgtagaaaaattgactacaatttacaaacaagaaatatacgactatctacacaaattgaaaattggaatactgaatatcaaaaatttaaactacataatacaaaactatgtaaacacgtcccttgacatgttatcaataatattccaagatatccaagaaagtgtagaaaatgtaacttataaaaacccttacgggccaaaaattggacgctcaaacgaagcttccgttttaataaataaaaaactttaaaggagtttagagtggattcaacattttcaggaatagaaattggcaaaagaagtttatttgcacataaagatgctatgaatacagttgggcacaatttatccaatgctacaaagcctggatattcaaggcaaagagtaacaatgaaaaccgaaattcctctttatgctccacaattaaacagagccaaaaaacaaggacaattgggacaggggattgttgttcaatctatagacagagtaaaagatgaactacttaacacaagaatcattgaagaatcgcaccgactaggatactggacttcacaagacaagtttatatcaatattagaagatgtttataacgaacctgaggatcaatcaataagaaaaagattaaatgatttttgggaaagttggcacgatctagcaaatcaaccacaaggtttagcagaaagaaaaataattctagaaagaggcaaatctttttgtgaaggaataagaaatagattccattcgcttgaaagaatttacataatggcaaacgatgaaataaaaattacaacggatgaggcaaacaattacattagaaacattgcaaatcttaataaacaaatttcaaaatctcaagcaatgaaagacaatccaaatgacttaatggatgcaagagacttaatggttgaaaaattaggcaatataataagtgtatcaattgaaaacaaacaagatcccaatgaatttttaatccacgcagaaggaagacatcttgtacaaggttcaattgcaaatgaattcaaactagaagctacaaacgggcccaccagaactagatggaacattttatgggcaaataatgacaaagcttaccttaaaacgggaaagctgggatctttgcttaacataagagatgaagagattaaaaacgaaatcaatgaactaaataatatagctgccaacattatagaaattgttaatgaaatacatgaagcaggacgtggaatggataaaaaaaatggaagaagttttttttctcaagaactaaaactaactgatgatcgaggtagatatgatactaacggaaatggtcagtttgattccgttcatattttcaaaattaacagcacaaatgaaatatttccagaagaaaaattgggattttacggaactcttaaatttgaagctacaaatagtaatgaaattgtagaaataccctacaatgctccagatacagttcaagatgtaataaatagaataaataattccaacgcacaagttacagcaagaattaactcagaaggcaagcttgaaatcaaagcagttaaagaacaagaagatgagaatataacatttaaaatcaaacatatagaagattctggatcatttctaacaaaatatacaggaatattaaatgcatctggacctgagggagcttatgattataaaaatattgacacaacagacaaattggcgcctaaatcgacttattcaatctctcctctaaaaaatcctgcagcatggataaaagttgcagacataatagactcagatccttcaaaaatagcatcgggaattaaaaatccaacaaatgaaatatctattggagataaccaagcagcactaagaatctcctcttttggaaattctcagattatgattggcaaaaatttaacattaaatgattactttgcaaatacagcatcaaatatagcaataaaaggacaaatttcagaaatcacaaaagaaagccaatctcaaatattaaaagatttaacagatctaagaatgtctatttctggagtaaacaaagatgaagaacttgcaaacatgatcgaatttcaacaagcatttattgcagcaagtaaatttatcactgtttctgttgaactaatagacacagtaataaataaaatgggagtataagcatgataaatagagtaagtcatccattaacatatgaaaatttcaaaacctcttcagcagagcaagagtctaaaattacaaaacttttagaaaacttatacaaaggcggcaaaaggattgtaaaattaagaaacgatccaacaggcgttactcacgcaataagactagataacgacatatttaagcttaatgtatacataaaaaatattgacacttctaaaagcaaccttagatatacggaaggatatttacagtctcttacaaatattttaacacgagctaaagaaattgcaattcaaggagcaagcggaacttatgaatcagatgacaaaaaaatgatatcaaaagaagtaaatgccttgcttgaagatgtagttgcaatagcaaacgccaaagggcctgatggatacagcatattctcggggactaaaattgatagcgaggcgtttaaggtaactagagagaataaaataagcaaaacaagcaaagacggtgcgggcccccaaataatcaaagtagaatacaacggcaaccaagctgaaaaaaaaacagaggtatacaatgacattcatatgtcaaataattaccctggaaatgtaatatttttcttacaaaatcaaaatattatctcatcaataaacactaatggatttgccgtaaaagaaaatacaaaaatttatattgacaatattgagataggactaacagcaggagatactgctcttgacatcgttgcaaaaatcaatgaatcttcagcgcctgttgaagcaagcattgatcccgttttaaactcattgtctattaaaactacaactccacaccaaatttggataacagaagaaaaggaatcaaatgttttacaaacacttggaatacttaccaaaaacaatgataccaaactacctccttacaacctttctagtagcacagaagttagaagtaggtctattttcgatgcgcttattgagcttagagacacactttacaataacaaagaagagcttgttggaagtagaagtctggcagaaattgacgaaagcttaaaaagattacttatatccgttgcagatcttggagcaaaagaaaatagacttgatagaagctatgaaagaataagcaaagaagctgcagatatgaaagaagatatgattcaatatacagatcttgatgtaacaaaagcaataactaatttaaatatggcaagcttagcttatcaagtgtctataggaatctctgctaaaataatgcaaacgactttattagattttataaaatagaatgatagatgaaaaaagtatagaatttgattttcccgagggaatacttggatttgaaaacattaaaaaatttataataaaagactctaagtataagcctttttctattatgcaatccatcaataaagacgtaagttttttggtgacatctcctttcaattttttaagcgaatacttaccaaatatccaggaaaaagattggtcggacattaaagcaaaagaagaagatgaaaaagttatactatgcataatcaatatgcatgtcaatgattataaagacattacagctaacctaaaggcaccaatcataataaacaaaaaaaaattacttggaaaacaagctatatgcacaaatgaaaaatactcactacaccataaagttttcaaggaataaagatgctagtattgtcaagaaaagcaaatgaaagcattaaaataaattctgatattgaggttttaatattagaaataaaaaaggatgctgttaaaatagcaattaaagcccctgaaaacattaaaatatttagatctgaaatttatgaatttattatagaagaaaacaaaaaatcactactaaaagacaaacacaatataagcaaaattaaaagcctttttaatcattatttcaagaatgaaaattaacctctgcatcactttgtcttatgtaaagaggtcctgacaaaatatcatcaccttttcgattttttaagtatttagctaccccaagttctgttaaaatttttccaaacgaacttaaattttcaatgattttaaatttataattgcactctttgcaaacatcttcaagattgttcccaataagcactgaatttggatcaatctgattcaaatattcaaacaaatctttcttagaaaaacacaaaatcttccctatcaatttgcaatttttataattcccaagaaaatatttacctgcagtaaaagttaatacaactgcactggggttattttcaactaaatttgcaaaaacatctaatgtggaaatattgacaaaaggaatagaaagacctaaagcaaggcctttgacaaaacttaaactaattctaagaccagtaaaagaaccaggaccacaagaatttataattaattcaatttgattaagatcgatattatttttaattacaaaatcattgaaaatttttggaacactaaaatttaaatttgatttaagtttaaccaatgaaaaattattattattaattctacaataaactattaatgctttatatgaatattcaaatgcaagtgtattaaccattaagttctacaaccctgcctgaacctactattttaaaagttaaagaaaataatctatcttttggaacaatgctcaaagcaatttgtggccattcaatagcaataatcgagtcaagatccataagtatttccaatcccccaacaagctcaaattcttccaaagaagacacccgatataaatcaatatgataaaatttaaaatttataaaatcataaacattaacaatgttataagttggacttgtaaaataagaaattccaaggttaagggcaagtccctttaaaaaactagtttttccagatcccatgtcaccacttaaaacaaatattttaccaattggcaaaggataaaaaaaagatttggaaaaatttatcatttttttttctgacttaaattctaaaatcaaggaagcttacctttaaactccaaatcgattacacgccttttaattgcaaccattagttttaaaacaggataatttaaaagatctataaaatcaatagtgacatgcttttctcctaagggcgtagcttcaattacaaacttgacttttttgatttctaagatatcattatacttataaataacatcagcaaaatatacatttctatagtatataaaactctcttgcttttcaatattattaagagaaataagctgcacaataataatccttaaaataaattaaactcccaaaaagccaacataagaacatttttatttagcgctatttttcaaggcggaatttttattcttaacctctgaattgcttttggctatcattgactaaaaatattcaaattcctaaattttatgagatgtcgcaaaaaaataactctaattcttaaaattaaacctcccaggagctttgatttttcatcttcttatttctaaaacaatttttttaaaagcttcaacatcctcaattgctaaattagacaaaatttttctattaatttttatattagacttcaataaaccctcaataaatcttgaataagtaaccccagtatcacttaaagcagccgaaattcttgaaatccacaagcgcctaaaatctctttttctaacttttctatctcttgtggcatacatcataccttttytcaaggtatccttagcttttttataattgctcttttttgtaccccaaaatccttttgttttttttaaaattcgcttacgccttgcaacgtgaactgtgccgtttttagccctagccatatctatctcctaaaattattttaaccataaggtaataaagttttaattcttttaacttcaaaacaagaaagattgcccgatttccttaaatttctcttgcgcttagaagatttttttgtcaaaatatgccttaaattttgttttttatacttaactttaccgtttacagtaaaagaataccttttttttgcacttttgcgtgttttcattttatttgccatttcttcccctttaatttaatatttattttttaaacttaggcgctacaattaaaaacattgttttgccttccattttagccgcagattccaaaacataattcacatcccctactttttcaagaatgctatttaagataccatatcctaaatatgtgtgagcaagttcacgacctctaaatcttattgtaactttaaccttattgccatcttttaaaaaacctaaaatgttttttgatttaaaatcaaggtcatgagcatctatcttgggctgcattctgacttccttaagcttaattactttttgatttttcttttgctctttttgacgcttttcttgatggaatttatattttccataatcaataatcttgcaaaccggaggagatacattaggagaaacctcaaccaaatcaagtccagcttcttttgcttttttaatagcatcttcaatcgataaaacctcttgtgttccattttcaaaaataactcttacctcgcgagccttaattctgtaattaatttttaattccttgtcatttgatctggacctatccctatctctattggcatttctatttatcatctaaaaaatatatactcctaaatcaattaataattaacattaataattaattttattatacattcactaaaaagtaaattctaggaataatgtttacaaaaagtaataaaatcaataatattgataaaacaaatatccaaatcacacaagtttttagtcaatcaattgatttaaaaaacgtttaaaagtagaattgtacttacaatgagtttatttttattaacaagtctaccactaatattaaaaatttatatgaatattcggctaaaacaaagtcaaacaaaaaatacccaagcccatgttttagcaatatttcttgcaataacaatgttttcttttctttatttaactcaagaatttattctatacagatcatttgaattagattacacatcaagaataagcctggggatttcaatatttatcaaagaacatttatactactatatattcccactattaatatttatatttttctttactctaaatgaaaattctttatttaaaaaaaaattaacaatacttatatatttcacatttggactaatattttctaaaaacttagaaataataattctaaatagcaaaatttttggaatttatgaatatatagaattaccaatacttaatgcaatagaactaatcttttcggccataatttttgaaaagaaaattaaaaaatgccaaaaatactcggcaaaagaatacaaaattattctttctcctattctatttttaggattatttattgcaactttaaaaacattaattttaaccaacatgagcatctatgcactaataatacttggtttggctttaatatctatgactattaacaataaatatactgagaaataaaatgtctggccctaaaaaacttgctataatagcgctcttagtaatttcaatacaaggatgcaaagaatcttctattattgaaaaacaatttaattatgcaataattttttcagatgcaactgaatatttttttgaaattcaaacaactccattcataaaaaacgaaatactatttataaatgacaaaaatttagaaattataaaagacaagcttaaaacaacaaaaaaaatactattaactcataaatcaaataatgaaattctaaataacgaaattctaaaagagaaaattttttatctatcaaaaataaaattttctctaaaaaaatctattgactttctgcttaacgaaaaatcaatagatttgcaaaaaacattactatttagagacaaatctctaaataacgaagaccttgaatacttggaaaaaaaaggcaaagaaaaaaatgtcaatattactctaataaacgaaaaaaacatatcctatattcaaacattcattacttctcaaataaaaacaataatattattctctttaagagataataatattattttaaaaaagatactaaattcgcctttttctaaaaatataaaatttgtattaattggcaatacaagaaaagacttaaaaattattaagctaaaatatataatcacccttaaagagcctgatttgataaaaatagcaaaagatgttgaaaaagattttcaatatgaatttaacatttataaacaataaaaatgattaaatttaaaactaataataaaccatacaaataaataattataaataaaatttaatgcagcaataaaagatctttaaagctattatatactgcaaaagcaacatcattaacagagcaatttttaatccttgcaatctcaaggcatacatatcctaaaaacaaaggtgaattaattttgcctctcaatggcactggagctaaaaaagggctatccgtttctattaaaagatcatttatatttaatttgccaacaagaattcttaaaggttgtgcatttttaaaagttatattgcccgaaaaagaaactttaaatcccaaatcaataaattttttagcatgctcataagttcctgaataacaatgcaatatacccctatttaaaaaatttaaagaccttacaatattatagacatcatcataggcatctcttatatgcaaaataactggccttttatatttatcagccaaatacaattgctcttcaagagctttaatttgaaatttcttgttatctgctttaaaataatcaagacccatctccccaacggcaacaacattttcactaatcaaaattttctcaagctgtttaatatcatctttaaaatgatcacttaaatttaaaggatgaatacctgctgttaaaaacacattggaataagggcttaaaagatcttttctgtcattaaaatcactaggatgcaatccaacatcaagaaaataagaaaagccgtttttaaaacattcattaataatgtaattgacatccaaagatcttttctttaattcataaaaatgaacatgagtatctattaatttatcaaaaaaaatagatttttcagtttcaagtaaagaatccatcattccatttttttcctaagaaccgcaaggtagtcaataacaacaatatttttcataccaagctgtaaaaagcttgataaaatatcaacagcatttccaatctgccctaatgcttcataacattcagcagcattaacatacaatgctgaatttttaggattgtttttaattaaacttttaatagctattaatgcttcttcatatttaccttgttccttttgaataagagcaagtccaagtatggcaaacatatcaaaatcaacatcaagggcctttttataataaatttgagaattttcataatcatttaaatagcgataagcatcgcctactcttgtaagaaccaaattattttttggatctttttcgataatatcaagccaatattttaaagcctctttgtactccttattgcctctataacaatcagcaagtccaaaaacagcataaaaattgctaggtgaaatttctaaagcttttttaaaaaaataaattcctctggtaaattcccttagcttacgataacaattaccaattgaagttaatactctaacatcaactttagattgatttaattcatacattttaagccaatactttaaagcctctttatattctttaaagtcataatacaaatggccaatacctacaagagcataatcattatcaggtattaattccattaccttaagataagtttgcttagatttttgaaaattttttagcttcctgtaagatgccgcgactcttgttaaaaccgttatattctcaggatcatattttaaatattcttcccatatgtctgtggcttttttataattatctaaatttctgtaacaatctccaagtccaaaaagagcataattattgctcggatgctttacaagacatttttgataataaactattgctttatcgtaattattcttcttcctttcaatgtctccaagcccaacaagagcataattattctcattatccttttcaaggatatcagaaaataaactttctgcttcagaaagtctttcttctttgatcaactgataccctctttttgatttctcagtgacatcaagaagttgatcatcagaaatgctcgagagatctcctaaagcatccaaaattttttcatttaacataaataccccttttaaatcggtttatcaaagatataacttcaactacctcaaacacaccgcaaataataatacgtaaagctcaatttatatataaatacaacaaaacctaatttaactttaatatccaacttaataacatttattatataaaaaaacatgaaaaaatataattgatttttttaatcacgcttattctatttatttaataaaagcagttttaaaaaagaatgttaaaataaaacataaatatgggaatctacacaaaacttattaaaaagtctaacaaaaaaatctaaaattaatataaactattactatctttcaggagaaaccataatgcttttagaaaaattaaattcagcaacaagcaagattaagttgatagaagaaaaattacaagatataaatctaattaaagatcaaaaaaaatattcaaaaataataaaagaatatacatatttagaaaaaataaatactaaaaaaattgaatacgaaaaaatattaagccaaatcaatgataccaaaaccatcttggaaaaagaagatcaacaagaaatgaaagagctaataaaacaagaactaattgatctggacaaaaaaaaagaagatcttgaacatcaaataaaaatactacttttgcctcaagatgaaaatgatagcaaaaatataataattgaaattagggctggaacaggtggagaagaagctgctctttttgcaaacaatctttatagtatgtatataaaatattcagagaaaaaaaaatggaaaacagaaattataaacttcaatgaaacagaacttgggggatttaaagaaataatatttgaaattaaaggaaaagatgtatttaaaaaattaaaatacgaaagcggtgttcacagggtacaaagaatccctataacagagtctaacggaaggcttcaaacttcagctgctactgtagcagtgctacctaatattgaagaaactgaaattgacatcaatgaaaaagatttaagaattgatgtttacagatcatctggagctggtgggcaacacgtcaatacaactgattctgcagtcagaataacgcacctaccaacaggaattgttgtacagtgccaaaacgaaagaagccagcataaaaacaaagatcaagcaatgaaaatattaagagcaaggctttatgaatttgaagattcaaaaaaacaagagcaaagatcaagcaatagaaaacaacaggtcggctcaggagatagatctgaaagaattagaacctataattttcctcaaaatagaataacagatcatagagcaaacatcactctttataaattagaagaatttatgcaaggagaacttgacccacttcttgatcctttgatgatagcacttcaagaacaagaattaaaaagcaatagcatatagcaatgaatataaacgaagttataaattatgctaaaggtamaaatttagatacaatagaagcactactaatacttgaattaattttaaaaaccaaaaaagaattaataattgcaaatataaaaaaaagcttaacaaaaaaagaaaaaaaacttttttttgatcaaatagataaaatagaaaaaggaattcctattcactacatacttcaaaagaaagaatttatggggattgaatttagcctaaacaaacatgtattaattccaaggtttgatacagaatgtttagcagaagaagccttaattcaaatccaacaaaatggttttaaaaaaatattagacttatgctgcggtagtggatgcatagggctttcgattgcctattacattagaaaaaaagtaatactctcggatatttcaacaaaagctttacaaatagttgaaaaaaatacaaaaaagctcaaacttgaaaaatttgtagaaataattcactctaatttgctaaaatgtataaagggaaagcttgatataatcattacaaatcctccttatttaaataaagaagaattagaaataaaaaataaaataaaaaaagaacccacaaaagctcttttgggatttggaaaagatgggcttaatatttctaggaaaatattaaaccaagcaaaagaaaagcttagcccaaatggattaataataatagaatcggctccttggcaaataaaaagcttgaaagattttgcaatcaaaaagggattttcacatttaaaaacaatttacgatcttgaaaagagagcaagggcgctgatattgggacaaagagatgatacaagcatacgaaattgcacatttaatcaagataaatgatcttgaaaaagctagaaatatttttaaaaaaactgttgaaaatacttacaaagatgaatttgaacgaaaaagcatattcaaagctctagaaatagcagaacagctccactatggccaatatagagaaagtggagagccttacattattcacccaataatggtttcattatttcttgccaaatttcaactagattttaaagcaactattgctggactactgcatgacgtacttgaagatacaaatgttgaaaaagaagaaatagtaaaagaatttgacgaggaaattttaagcctaatcgacggtgtaactaaaattcatgatttacacaataaaacaagaagcataaaagaggctaatactatctcaaaaatgttttttgcaatgacacatgatattagaataataataataaaactggcagataaacttcataatatgacaactctctcttatttgcccaaaaacagacaagacaggattgcaaaagattgcctttcaacttacgttccaatagcagaacgccttgggatctcatctcttaaaacatatcttgaggatctttcatttaagcatctttatcctaaagattataaagaaataaaaaattttttatctgaaacaaaaatagaaagagaaaaaaaattatacaaaggaaaattatcaatagaaaaagaacttcaaaaaagcggaattgaagcagaaattacagtaagatcaaaacacttttattcaatatttagaaaaatgcaaacaagaacaaacaaacttactcaaatttttgatactctaggaataagaataatttgcaaaaaacaaaaagaatgttatgagatattagaaattgttcaccgggtgtggaaaccaatcccgggaagacttaaagactatattgcaagcccaaaagaaaataaatatcaatcactacacactactgtaagaatacctgaggataaccagcttattgaaatacaaattcgaacagaagaaatggatagaattgccaattatggggttgcagcccactggatatataaagaacaaattgaacttaaagctgatgatctttcatttataaaccgaataaaaaaatggcaacaagaatcggccaacaaaagtcaatattcaatgaatgacatacacaaagagttgttgaatacattcatatatgtttacaccccagaaggagaagtagtagaacttccttttggatcaaattcaattgattttgcatacataattcacacagatattggagatcaagctctttatgcaaaaataaacggaaaaataagctcaatcacaaaaccgcttaaaaacgaacaaattgttgaaatattcacatcaaaagactcaaaaccggatgtaatatggctaaacagcgtaagaacaaaaaaggcccgatcaaaaattagatcatggcttaacaagaatgacaacacaatttttgtagacaacaatattattgcttatcttgttggagcaaacaaagagcaaagaaagcttttcagcttattcaaatcttataccaaaaccaaaataaaaagaattgcaatagaccctgaatgtagtccaacaacaggtgaagatattattggaataatacataaagacgaaataatagtgcacaatgaaaattgtcaaaagcttaaatcctataaaaaaccccaattgattgaagttgagtgggaagcaacaccaactagaaaagtgcatcacattattttacttttaaaagagcttaaaggaatatttagctatcttgaaaacattttcacactcaatgacgtaagacttattagcgaaaaaatagaagactgcggaaatggtcatggaataacaaatataatagtctcatcaaatgctaaaaatataacaaaaattatttctgctttaaaagaaaacccaaatatcttacaaataatgcaaatagaagaagacattaaaaattatgacaattaatatattgttattattgttattgcttagctcaacaggccccaccattgtgccaaataaaatggaaaaaaatgcattcaattcaagcaataaaattacaagcatagaaactgaaaagaacataaaaacgcacattagaaaaattcatcaactaaatgaaagacaagaaaaaataataaacacttttaattatataaaaaaatattttaatacaaatgaagttaaatatatggaatactctttacaagagattggatttattggatattcacaaaaaataatacattctaaaatcaaagggaaaaacgcaaatacttataatataatcactccaattaaaatacaaaataatttaaaaaataatttagcaattggaattgcaattgagcttttaaataaacttaaaaatactaatcctgaaaacaacataaattttttttttgttgaggatgattctttagaacaaaatacaataattagtagcagaattttacttagtaataagtatttggggaaaaatacaaatacaatatacttaatgttaaacgaaaataaaataaaaaataaaatttacttagaaaatgaatctttcataacaaattcaaaaacaaatttaggatttttaaaagctattataaaaacttttgaaaagaataaacttgattttaatacagcaaaaataactgaaaaaaaatcaaacaatttgtacaatctatatcgtgatgaatctataccccttttaataataaataataatttaaaccctatattaactcaaaataaaaatactatttttgaaatttacaaatcaatcgaagaaacattaactaatgagtacaaaagtaaaaataccgatgaaacacactatattgtaattgatacgccttttaaaaaaataataattaatgaaattgctttaatagcattaatttacatttgttataacttaattataattgtatttattagaaaatttaaagaggccggaatagttatgaaaaaagtaaaaaataattattacaaattagtaagattgttttttactttgtttttaagcacttacatatccttattgcttacaaataaaatatttgcaggctatgaaaacacagcgatttacagcataacaaatcccaaatatctaataactttttttscaactttgctcatacataatcttttatctctttttacatataatttcacaatatatttaaattacagacaacttaaatacctagcaatatcaacctctattatcgaaccaataatattaatgtttattaaaatagaatttatcttaataattatcataaaaagcattttattattaataaagccaaataaaaataccattattcgaaaaatagtgatattaatcatttggataatcaattttgtattaataacattaatacaaaatactacatcaatcaaaaatacacttacactaagctatataatatcaacttgtcttttctctagcatatttattaatatctcagaacatttaaaatccaaactcccaaaaattaaacaaaatttaaaaaaagctgaaaaccttggtcttgtaactttttttttaataaccacaatcataatatccagcaatattgataaaaaagagcatgaaatacaaatagaacaaacggttagctttcctgaaaaaataaacaaaataaaaattgaatatccaaaagataaaaaacatcctatccaaataatttcaaatgactttaatctaactttacaagcaaacgaaaaaatattaaaaactaacattgaagtcgatgatgagctaatgaatattgatttaaaaaaaatagatatagcagaaagagctgtttatagtatcgatttggttactcaaaaaattgcaaatcaaatcgagctgcattttaaaaacgcatctaaactaataatttatcaaagcaatactccttataaaatattggctaataaaattatctttacgcttaaaaacattaactctaaaaaaacaacaattgcatttactcttaaatctcaagatgacatagcatatgaagcatttgcaaatatttatattaaaaaaaatcaaattaaaatttacaataaaactaataatacagaagaaaaaaatataaaaataaattattcttacaaaataaaatattcaggaatattacctaaagcagaaaaatataaaaatcttgaatactttaaactaaaagatgataaagagattgaaaatctaaaaaatttaaaattaaattaatctaataatctaaattaattttcaaaatcaatcctttttttcctattaatgtaactttgaaaagcataatcaattaaattatccaccaggtctttaaactgaagaccatcattgctgcacattttagcaaacatagatatatcggtaaatcctggaatagtgtttatttcattaagataaatagttcctgattttttttcaacaaaaaaatcaactcttgccatacctctgagttctagattcttataagtaagaaaagcatattctttaatgcttaataactgatttgtctcaagatgtgcaggaatattaaaaataatagaatttccaggaataacagaatatttagcatcataatcataaaatataaaatcttgcacaacaacttccccaggagaaaatattttcatcttttcattcccaataatagaacattcgatttctctagcctcaataaacttctctattacaatagtaaggtcatactttaaagcttctttaataaaagattcaatctgattttcgctgtaagctacatttattccaattgaagaccctaatactgcgggcttaacaataacaggatagcctaaaacctcctttacatttctttttatttcttctttgtctaaaaaataatcatgctgtctaaatccaataaaaggaaccaaagggatatcaaaacttttaagcaaaagtttgcaaaaatacttattactagaaatggcgctccctataataccagcaccaacacaaggaatgtccataacctttaaaaccccttgaatagcgccatcttcaccggttcttccgtgaacaacgggaaaaacaacatcaatttcaagatttttattgtttgaaaaaattccaaaacctggcaataaactaacaataggtaaaacatctgtattaatgggcttgggaggatcagaaacagaatctaataaataccaaacacctgtacacttatcaatataaacaggataaatattgtatttatttagatccaaaagggctaaataaatactataagcagatttgcaagaaatttcatgctcaaaagaaacgccaccaaatatcaacataagattttttttcaaatcacttctccttttctgatttttctaaacttaaaatagcatttttaactacctcttgttcattccaaaaaacttctctatttttataaattattgaactttcatgacctttgcccaaagcaacaaccaaatctcctgcttttgcaagacttattgctttttcaatagcctgctttctatcagcaataaaaaataaatccttattttcaactttatttacaattccttttgcaatgtctttaattatacacatactattctcgcctcttggatcttcatcgcaaagtattattaaatcagaataaatatctgcgatttgcccttgcaaaaatcttttttcaacatctctttctcctgcagagccaaaaacagaaatcaatctattggtagcaaatcttttaaaaataggaaaaagcttggaaaaagcaccaggagtatgagcataatcaattattacagaaaaattttgccccaaattaatactatccatacgcccatcaagacttttaatgcagttaagtttatcaacaatatcttgaatatcgatatttaaaatttgagaaactaaaataagagcagccattacattctcaacattaaaactccccagtaggctaacattagcaagatatttaacccccttgtgataaaattcaaatctagtagaatcggttttctcatcaataaaactaacaaaaaaatccgctttactgctttttaagctataagtaaaagatttcttaacagcattcttaaaatcagaagaataaaggtcatcaagattaataaccccaaaaccagcatcatcactaacagaccgaaaaagacccagcttgacattcaaataattttgaattgtgccatgaaattcaagatgctcatgtccaatattggtaaaaacaactgcaaaataattaacatcaataagccttgctgtttcaaggtcaagcccatgagaagtagattcaagaattgcatattgagcttcatttttaaccatggtgcttaaaaatgaatgtatttccgtagactcgggagttgattgtctgtaaggatttttaatcaagcttccactcccatcatcaaaaaatactgtcgatataaaacctactttaacacccttttttttaaaaagaagatatatataataacaaacagaacttttcccgtcagtgccagtgactccaataacttttaatttttttgaaggctcatcataaaaaatatttgaaaaattagacataaattttcttatgttaaagtcatctaccttaatataagtaacattaggactgtaaaaatccacatctcgtgaacacacaacaacattactacccttttgaattgcaatttcaataaaatcatgcccatcaaaatgaattcctggaagagcaaaaaacacaaacctgggcaaaaccaatttagaactataagtaactcctgatatttctaaatcaagagaaccttttacacattttattaaatcttgatctaactttaataaaacttcattaagttttttattcatacattaaaattttacataaaactaataaaaatagctaagaaattcaaaattatgcttcaatagaaaatatatttacaattttctatttttttaataaactaagcaatgttacaaggcgctgtacccaagtggctaagggagaagtctgcaaaactttgattcgccggttcgattccggtcagcgccttctaagatcaagtcaaaaatatttttatacttaaggacataacttaaagcatttttattaaagataaattaaaataatacatatatgctagaattaatcataatactactatttataatattatctgctattttctcagcatctgaaacagcttatacttcattaagcataattcagatacaagacataagaaaaaaggggaaatcgggaatatccgtgtacaatttggttcaatctccttcaaaattaattactactattcttatcggcaacaatatatcaaacattgtagcaagcacacttacaacaaaatttgtacttgaaaaatacggaaacagcgcacttgcaatatcaacgggcctaataacaataatcgttctaatttttgccgaaatacttccaaaacaaattgcaattttaaataatgaaataattgccctatctacttcattttttttaaagccattaatttttatatttactccactaatatatataataaacaaaatcataaaaaaaatattaaatctctttaaagttaagactagctcccaaatgactaaagagagcataaaaaatatgctctctttagcaggaagtttaggaattttaaaaaatgactctagaatatttatgcaaaaaatgttagatatagatcaagtaagagcttctgaaatcatgacccacagaacaggggttttttcactctcaagctcatcaaagctaaaagatgtaatcaaattgatcaaagaagaaggatactctagaattcctatatacaaaggacaaagcagagaacagataattgggattttaatagccaaagacctcatagaagtcaataaaaaagatatgaataaaaacgtttctcaatttattaaaccagctgtatttgtacaacaaaacaaaaggataaaagacatactagatattatgaggaaaaaacaaaaaataatggcaatcgtaatcgatgaatatggtggtttttcagggatacttacaatagaagacatagtagaaaaaatttttggagcaatatctgacgaatacgacattaaagaggaaaagcctctgattactcaaatcaacgacaatacttactcaatacttggagaaactacttttgacgagattgaagaggcaattgggatatccattaaacataaagaatatacaaatacaattggtggatacttaatagatctgcttgacaaaataccaacaaaaaacgaaaccgtaaaaacaaatgatggagaatattttattaaggaaattcagaataataaaattgaaacaataacttttatcaaatctaaaaagtagtgacaaaattcgcttactaaaaataatttaaaacattaggagaagcagatgtttgacataaaacaaatttttaataaaacttatgaatatttaataattattattaccctgatactaatatcaataatagttattgcaaacatattcatagtagggccatcagaagaggcaattgtacttcgccttggcaagcttaacagaactcttgattcaggaatacacgtcaagattccattaattgaagaaaaatttatcgtacctgtaaaaatagtccaagaaattaaatttggatttctaatatctccaagcgatattagagaaaatgataatgcaaacgacgaaagcaggattattactggggatttaaatatcataaacattgaatggttagtgcaatacaaaataagagatccttattcattcaaatttaaagtagaagatcctgaaacaacaattaaagatattgcaaagtcatcaatgaatagattgattggggataatactatttttgaaataataaatgataacagagtgggaataacagaaggcgtaaaatcttctatgaatgaaataatagataattataatttaggcattgatgtagtgcaagtacaaattagaaatgccctacccccaaaaggaaaagtttatgaagcttttgaagatgtaaacattgcaattcaagacaaaaataaatacataaacgaagggagaaaagaatttaatcaaatagttcccaaaatcaaaggtgaagcattaaaggttattgaagaagctagaggatataaagaaagcagaataaacaatgcattagcagacacagaaattttcaatgccatattagacgcttacttaaaaaatcccgatatcacaaaagaaagactttacaatgaaaccatgaaagaaatacttgaaaacaaagataacattgaattaattgacaaaaacttcaaaaattttctaccatttaaagaggtaaaataaatgaaatttataataaatcttttattatctactataaagattataacctttacagtaatagtttgcttgactattttgtctattttccagccaatttatattttgaaagaaaatgaaatttcaataaccactcgacttggaaaaattcaaagaactgaaaatttagctggacttaaatataaaataccattaattgaaaatgtgcaaatatttcccaaaatcattcttagatgggatggagaacctcaaagaatcccaacaggaggggaagaaaagcaattaatatggattgatacaactgctagatggaaaattgcagacataaataaattttacacaacaataaaaacaatgagtagagcttacgttagaattgatgcagcaattgaacctgctgttaggggggttattgcaaaataccctttgcttgaaattataagaagctcaaacgatcctattcaacgtttgtctaatggaatactcaccccacaagaaacaaaaattaacggtatttataaaataacaaaaggacgaaagataatcgaaaaagaaataattcgtatagcaaacaacaataccaaagatattggaattgaaattgtagacgtactaataagaaaagttacttatgacccaagccttattgaatctgtaaacaacagaatgatctcagaaagacaacaaatcgcagaagaacaaagaagcataggattagctgaaaaaacagaaattcttggaagcatagaaaaagaaaaactgaaaatattaagtgaagcaaaagccactgctgcaaaaataaaagccgaaggggatagagaagccgcaaaaatttattcaaatgcatatggcaaaaatattgaattttacaaattctggcaggcattagaaagctataaagcagtattaaaagataaaagaaaaattttctcaacagacatggatttctttcaatatcttcacaaaagaaattgaaagtttattagtataaattttttctttaaatacctgtaaaatatatattattaatctattattatagattaaataataatgcaaatctttatttaaatttaaaaaaatacccaaaaaatattttactacacaccttgaaaaattaactaaatttttagaaattgtccattttaaagcctaaaaactagctatgaatcatttttttagcactacatttgaaagctaaaatttaaaaagagttgacaaacatatatacttatgaaaaaattaaggtactagaataaaaatgctgctgtagctcagttggtagagcataggactgaaaatccttgtgtcaggagttcgattctcctcggcagcatgcatttatttaaattacaattgtcgctgtagctcagttggtagagcataggactgaaaatccttgtgtcaggagttcgattctcctcggcgacatttatttaaagattaaaaggatctcaaagtgatacttaaagaaataaagcaaataaaagatctaagcgaacaagacataattttctcaagaataggaaacttatcaaaacttggcacaagaataaatgaaaaaatcattaaaatactttccaaaggcaatacgccatacattcctgtacttaaaaaagaagaagatgaatcatatgaagacctgataaaaaaaataaatgaagaaattttaaatgatgatcttaactatttaagagaaaagctaatagataacctaaaagatgtatataagccctttaaggaagacgatccaatatttattaccaagggcaaaaaaccactcatgaaaataaatacattgatggagactgagcctaatcaaatttattggaaagaaatattggaaggaagctttaaaatacttccaagacataaaataacatctttgcaaaaaattttattagaaatatatcattattttgatgttaaaaagcttaggacaaaagaaaaccttaaagataaaaaaactttaaaaaaattatatttatactctgctagaagagactatgaattttttaaaggaaaagtcaaaacagaaggtgattcaatactactacattcagtcgatacaacaatttactttttaattacaattgcaaatttaaacaaaataaggtctttgaaaaatgcacctcgttcaactattaaattttttcttgataaaactgaatataacgaatttacagaatttttttatgcagaagacatgatactacaagccgcacttggatcattgctacactcaataggattaatgcatataacaatattggaaaatatggggaataaaataagccttaaagacaaaaattttaaagaacatcacaaattaaaaatagagcacttggaaaaaaatattaacattgctaaaaatttgtttagaataagagaagatatttcagctattacaaaaatgataatcaatggacaaaaagactaccttgatgctactggacatccacagctaaaaatcaacaaatttattcatgaacttgttagaattttttgtatagtagacacttacgatgaattggtaaatccaataataattaaagaaagtgctaaccctttagagactgttaaattcttaatagaaaatagtgggaaatactactggagcagaaaagagccaaaagagcaaacaaaaaacaaaaaatttgacattaaaatgctagaaaattttttaacaatacttgcaccttttgattatgggcaaatagtagatgtaaacaaaaaaaataataatgaaaatctttttcaagctgctgttctggaatacaaaatgagcattgcgccaaatctatctataataaacaaaaaaaaccagacttacaaaatagaagaaataataatggatcttgagaacaaagaaattttaataaaagatgcaaatggaaattataaaaaaaatccattaaacaatgtggatgattttgtaataaaaaacagtattccagaattaaataaaaatgaaattcaactcattccctttagttatgaaaaaaaaataaatcctacaatattttcaaaaaaataagttttgaccccccatacctttttaaattataaactgaaaattttgatgtatttatctccaaatcttcattagaaggataatgcataatgatgctaactttatcatttaaaattttaccctttaaaataatctcaagcaaattaatcttatttttataattaaacgggggatcaagataaataaaatcataaaaaagatcttttttactcaaaaaatcctctgctctttgaaaaaagaatttataaaattcctcaacaaaactaaaattctcaactaatgtaattttaatttttctattacattcaacaagatgagcaagactagcccccctgctaagagcctcaacagacattataccagtccctgcaaaaacatccaaaaattttgaattaacaatatccttgaaaataatagaaaaaaaggcttctctaacaagagacatcacaggacgaacagagccattcttaggaaacaaaatctttttacctttatatttgcccgaacttacatacataaataaaaattttaaaacaattttaaaaaacaatgaatatataaaattaaatttttgctataatcttattttaagagagaaaaatatgaaaggcattattctggcagctgggtatggaacaagatttttaccaataacaaaaacaattccaaaagaaatgctaccaattttaaacaagccagccatagattatattattcaagaatttatcgattcaggaataaaagatattttattaataagctcaagaagaaaaaaagttcttgaagattattttgacagagaaattgaacttgaaaatatttttttaaaagaaaataaaaaagatgaattagaaaagattagaagcaaaaaaatcaacataagcttcataagacaaaaagaaatgctaggcacaggaaatgccctactttatgcaaaaccctggataaatagagagcctgtagttgtagcttaccctgacgatctttgcattggaaatccaccattaagcttgcaattgatcaaactttatgaaaaaactggaaagaacataatatctatcattgaaaatccagaaaatataaatagatacggagtaatagatctctacaaagacgaaatccatgtaaaaaacattattgaaaaaccaaagattggaagtgagcctagcaataaagcatctattggaagatttttgtacaattatgagttttttgaacatttagaagaaggattcaaactacataaaaaaggtgaatactatcacatttatgctttaaaaaagctaatggatcaaaaaaaagtattatataaaaacattgaagggaaaagaattgacataggaactcttgagggttatctagaggcaataataaattctgccaaaaaagataaaaaattaatgggaattatcaaaaaaggaataaatgaaaacgattaaaaaggattcagaattttatgattcccttgccacattaaaaaagcatataaacaaatatatagaagaaaaagttttaaaatatagcatttcttcccagctttacaaattagaaaaacctgaaataattgaacttataaaaattagcaatgattatgaaaaagaaaaaaatgcatttaacacttcacttgaagaatgctactacaaaaacactcaaaatgaagcaattaaaaaatggatattagaaatagtaagaaacaaaaattttattcaaataagcaaagaagccaatctcaacaccaaaaaactaggaacaacatacaaactaaaatctagcaactttttaaaactaattgaaatacaaaatagcccttattattctcaagaaaaaaaagacatttacaagcaaattatattaaatttttccagcaatattaacattgacagcctagaacaaacaatagatattctggtagctgtaagaaacagaaataaaattaaaatattaaatattttaaataaaaatttaaaatatcgaccagaaaatcaaaaagtttttaaatcaagcttaaccaataaagaaagtagactaataaaattaaaaagaatgctaatacttacatattggccagttggatgtttgagcaaaaatatttttattaaaattttaataaaacmttacaaatacttggaagaagaaattctagcgctaaaatacaatgaaattttaaactacttacgtgcactaaaaactttaagtcttaatgaaattttttataaaggttcgagtaaaaatattagctttaattatttttttagcgatttcacacaatacgccccaaaagattttcaagacacattaaagtgttatttatatgtaattgaaaaaacaataacaaaaaaatatttaacttggtttttcaaagacaaaatatctaataattgggaatctttcatagatgcacttgaatacattgaaaaacataaattaatcaacataaaagaaaaaataaaagaaattataactgcaaaatttcaaacagaagatttttttatatcttttgacaaaacaaatttcaacccatacgaaagctcaatctttaaagaaagatacattaagagtgcatttttagaaattattatgcattatgtcaaaaaaaattctcagaatatagaaacttatggctggattgcattctatatttatgctgataataaggataaaaaaattttttgtcaacgcatgaaagaatttttcaaatctaaaacctttgaaatacaaaatcaaatatttgtatattttctatctttttacccaaatattgaatataagcatttcaaatttatatcagacatactactctaccttgacgaaaataaaattacaatacctaaaaaaataataaaaatacaaaaaataaatcctaaccaactagattaccaaaaatcatatcttttaataaaatcactaaaaacaagatcaaggattttaaaaattattatcaaaaatataagatttaatcttattgaaaaactggaagatgaaaatgagaaaaaattattacctgcaatgtgctatttaatatattgtgagaatttggtagaattaaaaaacaatagaaagataaaatctaatgaaaaaaatagtttattagaatttatttcttttttcaaaacaaaattgaagcaaaaaataaattttaaaaaagagcttatgaaatctaaaggcatttaatctaaaataagtataatgggaaaagaatgaggatttatttatttttaaataaaaattacaagatttttattttatttttaattttaatattaaattcaaaattggcatattctcaaaggctaattagaattggcaaagaagagatgaaaaacaaaaattacattcaagcaatcgaaacactaagtgatgctattaaaaaatatccaaaagtacaactcggctattactttttatcaatagcatacagagaaaataatcaactaacagaagcagaaggagcattgctcgatggaattgcagtagggggtgaaatcgactacatactatattatgaattaggcaacataatgtttaacagaggggaaggttactatcctttagcaataaaatattattctaattctattaaaagtagacctaattatgacagtgcgctactaaacagagctaatgcctatgttcaacagggcaaaataacttctaaagaaaaagaataccaaaaagcttgggactcttatactatggctatccacgactactctcaatttattacccttagatcaaaaacagaaaaaaaagacagcattttgcttataataagctatttaagaaatgaaaaaattaatcttgaacaacttgacaaaagtttgaaggggcgaaccgagcatattgtatacgcaaaagaagataaaaatcaaatacttaaagatagttttaaagacaacctagaaacaaattctttaattgagctagaaaaacttaattggcaagaggagttatacatagatgaataaaaaacatacaaatttttcggtattattgcttttaattttcttacttatcttatcatttgggggctttggttactatatatatcaaagcaaattaaatgacaaaaatcgagaaataatgctaaacgaagttaaaaatagcgtaatagatcgaaactataaaaaagcatattctgttgcaaaacttctgcaagacaaatacccccaaaatgaagacattgcaatgcttacaaatacactagcagaaattgccaacagtagtccttttgaatcaaaagacttgcaaagagattctgctaatcaaatcttagacaagatcaaaggtcaagacaatacaaaaacaaatgtaaacgaaaattttgatatagcatttaataatagatacattaaagacagcacaataacagaaaactactctgacagaaacgatgatgttggcattgaagatgaagacatatctgaatttaaaaaaagcaaaatcccagaaaaaataaaaccaaatacaaacccaaaagaagaagaccaaataatacaatctccaaatccgaaattaagtgttaatgaccaaaaaaatttatttaatttggaaaaactaaaaaaaaatttaagtggaaaatcaaatagtgaaaatattttaaacgattctcaaaaaatagaaaatgataagcaaaacacaaatttatccaaagaaaaaaattcggagaatattttaaaaactccggacaacagtaaatattcaaacaataacaatactacatctttaaaaaaaatttcttcaaattcccaaaaagaaagtgagctttctccacccagtcaaacaataatagggaaaatttataggccatatagctacttgataaaaaaagagctctatgaaatattagacgatattaataccggaagagtcacacttggaaaaaacagattaaaagaattaattaaaaaaggtctaagcaacaaatttcaaaaagtaaatgaattgattgaaaattcaaaaaataaagaagcttcaaatttactattaaccttaataaaaaaagatattgaaccaaatctcattaatataccaaaagatccttacaaaaaagaaatttttcaattagataaagaagacaaaaagcctcagtacctagaggaccttaaatctaaagttcattcaataaaacccattgatcttgaaaacacaaaatcacgccaacaagccattaaggatctaaacgaattcttgaaaaacaatcccaatgacgctcaggcctctaaaactttagctcaagctaataaaatacaacacctagaggaccttaaatctaaggttcattcaataaaacccattgatcttgaaaacacaaaatcacgccaacaagccattaaggatctaaacgaattcttgaaaaacaatcccaatgacgctcaggcctctaaaactttagctcaagctaataaaatacaacacctagaggaccttaaatctaaggttcattcaataaaacccattgatcttgaaaacacaaaatcacgccaacaagccattaaggatctaaacgaattcttaaaaaacaatcccaatgacgcccaggcctctaaaactttagctcaagctaataaaatacaacacctggaggaccttaaatctaaggttcattcaataaaacccattgatcttgaaaacacaaaatcacgccaacaagccattaaggatctaaacgaattcttaaaaaacaatcccaatgacgcccaggcctctaaaactttagctcaagctaataaaatacaacacctggaggaccttaaatctaaggttcattcaataaaacccattgatcttgaaaacacaaaatcacgccaacaagccattaaggatctaaacgaattcttaaaaaacaatcccaatgacgcccaggcctctaaaactttagctcaagctaataaaatacaacacctggaggaccttaaatctaaggttcattcaataaaacccattgatcttgaaaacacaaaatcacgccaacaagccattaaggatctaaacgaattcttaaaaaacaatcccaatgacgcccaggcctctaaaactttagctcaagctaataaaatacaacacctggaggaccttaaatctaaggttcattcaataaaacccattgatcttgaaaacacaaaatcacgccaacaagccattaaggatctaaacgaattcttgaaaaacaatcccaatgacgcccaggcctctaaaactttagctcaagcttatgaaaacaatggagatttgctaaaagcagaaaatgcatacgaaaaaattatcaaactcacaaatacccaagaagatcactataaacttggaatcattagattcaagcttaaaaagtatgaacactcaatagaatcatttgatcaaacaataaaactcgacccaaaacataaaaaagcacttcataacaaaggaatagctttaatgatgctaaataaaaacaaaaaagcaatagaatcttttgagaaagcaatacaaattgataaaaattatggcaccgcctactaccaaaaaggaatagcagaagaaaaaaatggcgatatgcaacaagcatttgcaagctttaaaaatgcctacaatctcgacaaaaaccccaattatgcattaaaagcaggaatagtatcaaataacttgggcaacttcaaacaaagtgaagagtatttaaatttttttaatgccaatgcaaaaaaacctaacgaaattgctatttacaacctatcaatagcaaaatttgaaaacaataaacttgaagaatctcttgaaacaataaacaaagccatagatttaaatccagaaaaaagtgaatatttatatttaaaagcatctataaatcttaaaaaagaaaattaccaaaatgctatatcactttacagcttagtaattgaaaaaaaccctgaaaatacttcagcctatataaacctggcaaaagcatatgaaaaatcaggaaataaaagtcaagcaatctcaactcttgaaaagataataaacaaaaataataaattagccttaaacaatcttgggatactttacaaaaaagaaaaaaattatcaaaaagcaattgaaatttttgaaaaagcaataatcaattcagatattgaagcaaaatataatcttgcaaccactctaattgaaattaatgataacacaagagctaaagaccttctaagagaatatacaaaattaaaaccaaacaatccagaggccttacatgcactaggaataatagaatataatgaaaataacaatgatcaaacactaagagaacttataaaaaaatttccaaattacaaaaaaaatgaaaatattaaaaaaataataggaatataaatttcaatgaacaaaataagattcttagataaatacttggttcaaaaaatagcagcaggagaatcaatagacaggccatgttcaatattaagggaactactagacaattcaatagattctggagctactaaaattgaggtttttcttgaagaagggggaattcaaaaaatcttaataatagataatggaagcggaataagtaaagaagatttaaaaatctgctatctaccacacactacttcaaaaatatcatcggaagaagatttaagaaaaatagaaactctaggctttaggggagaggctctctctagtattgcaatttgctccaacatttcaataacaagctcaacaactagcaatgaaagctatcaaatagaagtagaaaatggaattgaaaaatgctttaaaaaacaacccgccataaacggaacaatagtagatgtcacaaaaatatttcacaacttcccagcaaggaaaagattcttaaagcaagaacccattgaaacaaaaatgtgtctaaaagttttagaagaaaaaataataacccaccccgaaatcaatttcgaaattaatttaaatcaaaagctaagaaaaatttactttaaagaatcgttaattgacagggttcaaaatgtatatggaaatgtaatagaaaataataaatttagggtcttaaaaaaagaacatgacaatataaaaatagaaatatttttagcaccagataacttttctaaaaaaagtaaaagacatattaaaacatttgtcaacagaagacctatcgatcaaaaagatctcttagaagcaataactaatggacacagcagaatactttctcctggcaacttcccaatatgttatttatttttagaaataaaccctgaatatattgactttaatgtacaccctcaaaaaaaagaagtaagattttacaatcttccatttttatttaaactaatatctgacaatattaataatttttttgataaaaatataaataactaccaagacataataataaaaagacaattaacagaagatgatcatttaatagaaatgacaaaccaaccagaaaactttaataaaatcaacacatatgatataccacaaaacaataatttagaaacagaagatgtaaacgagccaaacaaaaacacaacacaaagcaatattgaccttagaaggtataattcaattatacaaaatagaccaacactcagggaaaacattggaaacattttctctgacaattttttagaatttgaagaacctccaaataaaaatgaaaaagaagaaataaaatttaactatattggacaaatattctctgaatttttaatcgttgaaaaaataaatgaaatttacttcatagaccaacacgcagttcacgaaaaaataatatatgaaaaacttagaaattcaaaaaaaaatgttcaaaaacttctagtaccaattgaattcacagtagttgataaaaacatagaagaaattatagatagtgagattgaagaatacaaacaaatggacattataatctctaaaataggccctaaaaaatatcaacttgaatctattcctaatatttgtagtcaatatgaaaatactcttattaacttttttcaatcaagaagaagtaggacaataaattctcttgaatctgacttatacgcaactattgcctgtagaaaggctgtcaaaagaaatgacatgctaagcgctgaatttagtaaatttttaataaatgaattttttaaactagaaatcaaacattgtcctcatggacgaaaaatttattacaaaatatctaaatttgaacttgaaaaaaaagttgacagagcataaaataaaaccagagttcccatgatgaaaaaaatcaaatcagaaatcaacttgttaaagatagaaaaagacaaaaatttaattgagcttggaaaaatattaaaaaataataatatagtagaattaaaaaatttaaaccactatcccaatttaaaattagtagaaaaagaattgtatcaaatgaaaagcaatttaagcaaatcagaagaaaatgaaaacatattaaaaaatttaaacaaaaaaatttatattcttaaaaaagaatataaatctactagtaaatcatataaaaaaaaccttaaagaaattgctaaaacaataatcgaaatttatcctcaaaatctagaattaatatcaaaatacaatatgaatttttctaaattgaaacttgaaaaatataaaaaaatagaattagcaagtgatcataaaacaaaaaattatttacaaagaataatgcttgaagttagctcaacaataaacaatatcattaatatgataaatgtatataaaatatcaaaagaatttgaaaagcaggtattcacaaaatattacccttctgaaaactttgaaagcataatgaatgaattttcattaaataaaaagttaaacaatgtaattgttaaagaatttaaaataataaatgaaatcaaaacaaatataaaaaacataaaagaagaaataaaagaaataatatctacaagcaaaaaagaaaaaatatacaaaaagaatacaataaaaaacgaaatcaatgttattacaaaaaacaaagaaaacattttaaaaaaaattgctgaagaatttattgaaatcacaaaaaaagataaaatgacagccaaaaccaatgcaatcagctcaataattcaaaaaatagaaaaaataaaccaaaaaatattaaacttaaataatgatttaataaaaataacaaaacaagaagaaataaaaaacattcaacaaaagatacaagctctaacaaaagaaaaaaataaaattaataacaaattagacgcattaacttctaaaatagaagttattcaaaatgaacttgacaatgaataaaaaataaatataataaattaaagctaagggcccatagctcagttggttagagcacccgactcataatcggtaggtcccaggttcaagtcctggtgggcccattttgatcttttcagccaactttaaaaaaaagatttgaatttttttcgacataataaaaacttatgtaattatcaaatgctttatcaatctctagaatatctattgaatcaattctaacaactgaagagaccggatgtagtttgtctttataagttttaacaaaaaatactttggaattgcttaacttgtttaacatttccatatctttagacttatatacataattgtgaacatcatctaaatcatattttgacatacccaaagaaataacaagctctctattgtatactctcatgcccttatcaaaaagacgaacacatgaggtaaaatcttcaaaagttttatcaaaaaaattaaacctcaaatccttacaatatagaatatcctttccaaggctagaatcaataaaaaaagagctataattattattaatcacttgaataaactcattagtgttcttattctctattgataatttaaaaacatcttttgaatttataactttaattgcaaaatcaaaactcatagagtaatctaagcgattttcagtaaaataataatttatcttataatcaagctcttttatctccggataatttatgtcgcaagaacaagcaaaacaacaaaaaaacaatattaatttaatttttaatccgctctgcatactctttagtttcagaattaattaaaaccttatctccaacgttaataaaaagtggagcttttactacaagccctgtattaagagtaatatttttcattgcatttgttacagtatcacctttaacagccgcctcaacttctacaacttcaaaagcaatctttggagccagcttaatatcaataaccacattgtcaaaagttacaagagaatagatttcagactcctgcaaaaaaggcactttatcttgtaaattagcactttcttttaagtccaaactaacttgatcataagtttctaaatccataaaaaccaaaacgtctttatctttgtataaatactgagcactaacttcataaatttcaatagcttctgcggtatctgccccttttaaagtttctctaatgacaaatttgttttttaagttcttaagctttaaccttactatcgcccctcccctacctgtttttgagaattctctttcaagaacaatatggggagcccctttgataagtaaaaaagaacctttttcaatctcactagatttcactactgccatttaaatacctcgcaaaacttaacatataaatctagtagtaatttataccaaaaaattaaaatatttgctattattcctcaattataacttaatcaataaagttaatttgtaattgacttattttaaattaatgctattatatacttaaacaaaggagtttgcttgatgaaaaaagttattatcttaatttttatgctatcaacaagtttattatacaactgtaaaaatcaagacaatgaaaaaattgtatcaattggaggatctacaactgtaagcccaatactagacgaaatgattttaagatataataaaataaacaataatactaaagtaacatacgatgcacaaggaagtagtgttggcataaacgggctatttaacaaaatatataaaatagcaatatcatcaagagatttaacaaaagaagaaattgaacaaggggcaaaagaaactgtatttgcttatgatgctttaattttcattacaagccctgaaataaaaattacaaatattacagaagaaaatctagctaaaatactaaatggagaaattcaaaattggaaacaagtgggaggtcctgatgctaaaatcaactttatcaatcgagactcttcttctggttcttattcgtctataaaagacctacttcttaataaaatattcaaaactcacgaagaagctcaatttagacaagacggaatagtggtaaaatctaatggagaggtaattgaaaaaacaagccttactccccactcaataggatatataggtcttggatacgcaaaaaattcaatagaaaagggtttgaatattctttctgttaacagcacatatcctacaaaagaaacaataaatagcaataaatacaccattaaaagaaatttaataatagttacaaataacaaatacgaggataaaagcgtaactcaatttattgatttcatgacaagctcaactggacaagatattgttgaagaacaaggctttttagggataaaaacataattaaattaaagaaaaaaaaacttgacttaagatcaagtcaagtaatacaatttaacattggcatgagctttaagggattcttttaaaaaatgcatctgagcttaaagacaaaaagaaaaataattgaaattattttcaaatcttttattcttatatctgcaataatcagctccctatcaatattgtttttgggtttgtttatattaaaaactggaataatgccatttcttaataacaaaattaaaattttaaactttttattcagcacaaattgggatcctactagcaatttacaaaaatcttatggtattttggcattcattattaattcctttttaactacacttttttctattttaattgctttaccaattggattgggatttgcgatatatttacttgaaaaagcaaaaggattttatagacaatttttacaaacagtaatagagcttttagcaggaatccctagtgtagtttacggattttttggaagcacatttattgcagctttagtaaaaaacatttttcaaagagaagacaatttgggatacaatttaataagctcatcactcatattaagcataatgataatccccacaataattagcgtttgttattcatcgctcaaagccgttccaaaatcatataaatttgcatctcttgcattagcagcaacagactggcaaacaatatataatataataataccatcggctagtcgaggtattttagcaggaacaatattggcaataggaagagctattggagaaaccgtggcagtattaatggtcggaggaggctctcctctttttataaaaaacatattttctcctattagaacactaactgtaaacattgctatggacatgggatacgcctcgggtgttcacagagaagctctcttttctacagctctagtattattgctattttcaataattacaaatttactcaaaaattttatactatcttccaataaagggttaaagaaaaagtgactaaaactcaaatcaataaattaattaataagttctatttctttataatcaattctattgcatattttttaacagcggtattaatttttctaatagcatatgtattgtacaactctttattttatttcaaaaaaaaacaaactttatttttaaacaaaactcaaagctttgtgccatttaaaacagaagacggcaaagaaatacaaattgcttttattgttaacaaaaatatcaacacagacaaaatctcaatagaagacattcacaacatatataataataaaatttcacactggggaagcatttcagatcagggaattgacattatacctattgcaagttcaattgacagcatatctaacaaagctattctaaaaacactaatcaaaaacaatgtatttaataaaagatacataaaaatcgaaccatctaccaaaaaaatacttcaaaccataaacagcacaataggctctgtaggctatttaacaaaaaaagaatttgaatccctagattttaaattatatcccaatattaaggctttaaaaataaaaactatgtctgtcctaataagtaaaaaaactttaacaaaaaatgaaaatgaaataatcaatacattaggtgttgatgaagttgaaaaacttattaaaggcaaagaaaaatgggtcaatttaatatcaaaagatattaaattaaaaataataaaatatcttgatcaagaagaaaatataatacaaactatagaaaaaacagaaggcgcactagcaattgtgccttggcattattttcaaaattttaaagcaccctttattaaaatgcattatattgataaaagtagtcctttaaatttaaatttcatattatctattccaagagattctggcgcatatggtggaatttcttatttaatattaaatactttttatgtaatactattaacaaccgctatttcaatatgcattggaataggaactggcataatgcttgccgaatatacttctagtaaaatattttacaaaatactgtctatgagcgttgacattctttcttcaattcctgcaataatttttggactttttggactgattttttttgtgccaattcttggaataggaatactctcaggagcaataacaagctccctaatgatattaccaatgattgttaaaacaaccgaagaagcatttaaaacaatcccaaaatcatacaaatacgcttcattcgccttaggggcaaataaaacagaaactataattaaagttatggttccagcagctattcccggaatactaacaggaatagttcttgcaataggaagagctttgggagaaacagctgtattgctttttacaatgggaacaaacttgggacttgcaacaaatttaaatgaaccttcaagaacattaactgtacacttactaatgttatttcaagaaggacacctggacaaaggatttggaacagcctcaatacttgttattatggtactcataataaatttaacatcaaaatttttaataaacaaattatataggattaaataagtgataaaagaaaaagatacaccaaaaaatgaagttataatagaaacggaaaatctgaatctattttatacagactttaaagctttaaataaaataaacatgaaaatactgaaaaatagtattaccgccttaataggcccatctggctgtggtaaatcaacattcttaagaactctcaacagaatgaacgatcttgttgaaggcattaaaatagaaggcaatgtaatatatgagggaaaaaacatttattcaaataatttcgatatcctggagcttagaagaaaaataggaatggtattccaaacccctaacccatttttaatgtctatctatgataatataagctatggtccaaaaatacatggaacaaaagataaaaaaaaactagacgaaatagtagagcaatcactaaaaaaatctgcactctggaatgaggtcaaagacaaacttcatacaaacgccttaagtctctcaggaggccagcagcaaaggctctgtattgcaagaactctcgcaatagagccaaatgtaatactgatggacgaacctacctctgctctcgatccaatatcaacaggcaaaattgaagagttaataataaacttaaaagaaagttacacaataatcattgtaactcacaacatgcaacaagccggaagaatatctgatagaaccgcatttttccttaatggatgcattgaagaagaaagttcaactgatgaattattcttcaatcctaaaaatactaaaactgaagaatatatcagcggaaaatttggataattttaacctagtgaaacatcgagaaacatcattaatgtaaaaccaataacaccaaatatacttggcactttattgtcaatgtcttttctcttagcttcaggtattaattgttcaattgacacataaatcatagctcctgcagaaaaagccaaagcaaaaggtaaaattcgagtaaaagaataaaccgcataagcacccataagcccccccacaatttctaccaatcctgacatttggccatagttaaagcattttgccaaagcaacattacctcttcttaaaggcagagaaatagctgctccttcgggaatattttgaataccaataccaagcgtaagaagcatagccccaactaaagtttgaatatctggattagacgccaaggctccaaaagcaactccaacagccaatccttctggaaaattatgtaaagtaacagcagtaaagagtaaaaaatcttttttaccatgtttagttaagtcttcatcaataaaagtaagtttatccagatctggaacaaatacatctacaatatatataaaaaatgccccaacaagaaatccaaaaacagccggcacccaagtaatgtatccaagctcttcagctctttctatagcaggctgaataagcgaaaaaaaactggccgctatcataatgccagctgaaaaaccaagcatagcgtccattattttattatctacctttctaaagaaaaaaactgctgctgctccaaaagctgtagtaaaccaagtgaaagtagaacctaaaagtcccaataatacaggatgcaaagttaataaataatctaaaattgattttatcataaagcctcctattaaaacaaatcaacaaataataagtaatttactcatcaatcaaaatagcttttattcttcttatacctgaagatgaggattgttctttttgtattttaaaagtaccaagttcattggtattctctacatgagggcctccacaaacttcaagcgaaaatccatctatctcataaacgctcaccaaatcgtcatatttttctccaaaaagagccatagcacctttttctcgagcttcacttaattccattataattttttttacagacaaagaattttttatctgtaaattaacaatctcttcaactttttttatctcatcatccgtcatcttttcagaatgaacaaaatcaaaccttaatcgctcagcagtaatattgcttcctttttgtctaacatgatcgcctagtactaattgaagtgccttatgcagtaaatgggtcgctgtatgtagtttagtggtctcataagtataatcggcaagccctcctttaaaaactttgtcaccccctttctttgaagttttttgatgctttttaaaatgctcattaaaacccaacttatcaacattaaagccatattcaatagcaagctcttctgttacttcgtatggaaaaccataagtatcgtatagtttaaaagcaatatcaccaggaatagtcttggaaggcaaatttcttgttattttaataaattcttgctctccttgagataaagttttaaaaaacttttcttcttctttgcttaattcctttttgataaaatcttttttttctgttagctcattataaaaagatctataaatagcttctacagaatcaacaagatcagctaaaaaatgggattttatcccaagtttctttgcatatctgatagatcgccttattagtcttcttaaaacatatccttgccccaaattggagggaaaaacaacagaactatcagcaagaataaagcaagcagctttaacatgatcagaaattattctaatacatctatcatcatcttctttttgtccataaattttaccagaaatatattctattctctttattataggcatgaatgcatctgtatcataaactgaagatttgccctgcaaaaaagcaattgtcctctcaagtcccattcccgtatcaacgcattttcgacccaattctatgtaattaccattttcatctttattgtattgcataaaaacattattccaaatttcaaaatacttaccacaagaacacgtaatattacagtcaagagaacacttagactttccagtatccacatatatttcagtatctggcccacaaggccctttagatccaacaggcccccaaaaattatgatccttagaaagataatgtattctatctttggaaatacccaagctttcccaaactttagcagtctctgtatcgcgcggaatctcttgatcgccttcaaatacgctcacataaagactgtcttttggaatatttaaataatcagaagatgtcaaaaattcaaaactacactttacagaatactctttgaaataagctccaagagaccaatttccaagcatttcaaaaaaagttaaatggcttaaatctccaacctcatcaatgtcgcctgttcttaggcacttttgaacattaacaagcatatctcctgatggatgcacttctccaagaagatacgggataaggggctgcatgccagctgtattaaaaagaactgtaggatcattttcaggaactaatgatttccccattatttcaaaatgtttttttgatttaaaaaaatcaatatattttttacgcaacttattaagtgtcattaaataaattcctcattttttctatatattattaaatcgccttttaaagttaaatttttaatataattaacaaaagctgttgtcatagtttttaaatcttttttacttatttttcctaaaaaagcttcttcgtctaaaatgatttctttgcgcctttttgaaacatttgaaagcattttatctctaacctcatcagctttatccttaataataattgcaatctctttgtctgtaaactctcttaaaatattatgaaggtcattatccattattctcaatattacattgatatcaaatattttttctcgaatttcactgtccacaacaggatttaaatcccgcatattaatattattaagcaaatttttctcttcattaaaatccatatagcttaaaatatcaacaagtatcttagatccatcaagtttatctgtcttaagattcccctgcatcttaaatctatccttaagcttatttgaaattgcctctattgtctccatgctcaattgccttggtttgacaagatcttttacaaattttcttctatcttcttcttctagcattgaaaaaacatattttttttgatctttatttaaataattatataatataacaagcgttttaatattctcatccttaattaatgcccaaagttgttcatgctcaatttgagacaaataatcaaaaggaataaaaatatcattaccagtaacttttttataaattgattttgccttagattttcctaacgttttatttaataactcataagcaaagttatcatcaaccttaacataccttttttgatttcttagtaactcttcaaattctttaataatatgctctttttcttctggagcaatatagctaatctttgaaatttctctggtaattaagattatatccgaatcatcaagctcagacataatcttagcagatttttcaagtccaatagccaaaaaatattttgcaatctttgtgaccttactctctttgcgaataaaccctggctttaactcattaatattgttggatttaggctcgacaggtgttttatttttatttcctttaataaggcttatccaagatctaagcatagagccttgaatctctgaatcggaaaaatttttatttaaacttaaagtatcaatttcttcaacggtttttttgcttaaatttttagcatttttatacttggaaagcctaggatcctgcataactttcatctcttttaatgtttgtaagaactagtaaattgggatgctctttgagaagtctggctggacattcattaatagaactattagaagctaaaaaattttctaaagcacactttttatcaacacccataaataacaaaacaacagcttttgaaccaaacaaagatttcggcgttaagcttattcttttgcttgggaatttgggagaattgtattcatactgataaccttctacatctgaaaacaacaattttcttgaaggaaaaagcgatgctatgtggccatcctcaccaacagaaactataataaaatcaaaaatattaaacctagaattaaattcaatattatagtcatgaatagctgtggcttcgtctatttcgctataaacaaaagcatgaaatttggaaatgcttattaaatttttatcaaccattttagaaaaaaaatttttatttaaaagattataattactattctcatcatttaatggaacacaccgttcatcaactaaaaaaaaatgcgatcttctaaaagaaaaattttgtttaagaaaaacgcttaaaaagttaactatacttcgaccaccacaaattccaatacttgtatatttatctttatctacattcatattaaaaaaatcaaaaaatctatcttttaaataattctcttcatcagaatataaaaactccatctaacttcccttaatacatattaatctaaataataataaatagttgaagcaatccttaatatttctttaggataaagctttgggttgccaaagattatatcaactagaaaaaatttaaagtattcttgatttgcatttttaattttatctaatttggaaccaaaatgtctcgtaaattctaaagcagaaagttctgcatttcttattgaacctgctagaatttgaaaatttgtatcattaattctatttaaataatatcttaaatctctattactgctaattggcaagccttgattataaaactcaataatatttttttctactgttttcattttttcaatatcaattgtattggtaattaaagcaatatacatacatatttaataaaaaagctttaatcttagataaatttaaattatttgctttaatgccgtcattaatcgaatcactattcaagtcataatgcaaattacaacttacagatgccaaaaggatttctttttcgcttatgcccttagccttaatacaattgccatttttaatgacaattccttttactctgcaagaaattataattgaaaatgacagaaaaagtattaaaaaaaataaatcctttcttccaggcatataacaattcctcctaaaaaagaataaataattgttaaatcagctcgtttattctaacatattatataatgttaatgaatcgaaaaatatcaatagccccaatggtaaacattacagacgagcatttcagatatttaataagacttttatcaaaaaaagttacattatataccccaatgatttctgcaaagtcaataattatgggtgatgtaaaaaaaattgtaaagcaaaaccccttagaatctccaattgcaattcaaatagcaacaaactccaaaaatgatgcccttaaagctattcaaattcttgaaaaacactttaattttgacgaatacaatcttaatgttggatgcccatctctaaaaatccaaaatgcaaattgtggagcttgtctaatgggcaatgctaatcaagtaggtgaaattttaaaaacgatgaaagaaaacacaaataagcctatttcaattaaacatagattgggtataaggcctttatctagtgattacaaaaatgaaagttattctgaggtaaaaaactttgtcaaaataatctcagattttggtatcaaaaattttattgtacatgcaaggattgcaatattaaaaggattttctcctaaaaataataggaatattccaaaattaagacatgaatttgtatataagctgaaaaaagagaataaaaatttgtttatcgagataaatgggggaatcaataactcagagcaaattaaaaaacacctatcttttgttgattctgtcatgattgggagaagtgcgtttgaaaatccatactttattgcaaacgcctcaagagaatttttaaacgaaactgatgaaattcttacaagaaaagatatattgatgcaaatggtagaatacattaaagaatacgaaaattatttgtcgatcaatatattattcaagcatcttatgggaatagtattctccaaagaaggagctaaaaaatttagacaaaatttaacagcaccatttccaaaaaacttaaaaaagcatgaaatattgctaaaagctatagaaacattgccagaaaaaatactaaattctaattcttaaaaggaatataatcaaagcctgtatacttaaccaaacttttaggaattctaactcctcccttttgatcctgaaagttttcaagtatagaaataataacccttgttgtagctattgctgttccatttaccatgtgtgcaaatttattttgtccatcttgatctttgtatctaatcttaagccttcttgactgataatctgtacaatttgaagttgaagtaacctccccataaccaccttttccgtctcttccaggcatccaagcttcaatatcatattttttataagctggagaaccaagatcaaaagaacaaatatttaaaaccctataaggaatttcaagctcagtaaaaatttgctcttgaatacttaaaaattcatcatgaataactccagattcttctgctttgcaaaaacaaaacatctccaccttgctaaactgatgaactctataaagaccttttgaaagctgaccatatgctccagcttcttttcgaaaacaatgtgaaaaccctgccattcttattggcaaagtgagatctattattttattataataataaccgccaagcgtaatttcagaagtgcccacaagatatttatctgtatcttcaatcttataaatattgctttcgttgccacgaggattaaaacctattccatcaactataaactctcttgcaacatcaggagtaataaaaacatcaaaacctttatctcttaatttatttaaagagaaattaataagagcaatttctaaaaaaactgcttcatttttaagataataaaatttactcccgctaatctcacgtgctctgtcaaaatctagaagatctaaatctctgccaagctctaaatgatcttttggcttaaaatcaaactgtggaacaactccaaccctttttatttcaaaattatcttcttcactactgccaataggcacatcaggtgacaaaatattgggcactttcttattttcaaggtcaaaatcaacagatactctttcaagctcttcttctagatcaataagctgttttttcaaaatctttccggtttctattaaagagatttttaaaactttatcaagattttcttgcattttagaagaattttcatttctttttgcattaagctcaccaattttggtaattagtttttttctcttatcatcaagataaattaacttatcaatatctaaaacaaggcctcttgctttaatacttctcttaacaagatcaaggttatctctaataaatttcagatcaagcatcctatctcctaagatatgtcttaagtaaaatttttaaacaaaattacaaataatattaattcatattaaggttattatataatatcttataacaggattagaataaatattgcagggagaaatcatcgcatgctaaatccaagaacaataaaaacaacttttatgttaatatctacattaatgatttttaacggatgtacaaaaaaattaaccaagatcaattttaaagatattagcttaaatagcaacaaaatgaattctttaataataaattcaataagctcaaaagaagattcacaattttatgaatacaatattagaatacccaaattaataattgagggaaaagaaaaaggaaatcttgaagaattgaataatgagattaatgaatatgtgagccaaattgtagcaagacttgacattgttagtaaagagcttaaacctgagaataaaaaattcagcttaaaaataaactatgaaatttaccatgggcacaatatttatacaataatacttattgcaacccaagaaattaatgatagccccattacaaattacagaagttattacattcaagataaaggaaattatattcataatattgacgacataattaaaacagatgaagcattcccattttttataaaaaaaattaaagaaaaaattctacctaacgaattattatttgatttacaacaagcagtaatttactttgaaaacaaaaaaattattattaaattcccagaatacacatttaaactagatgacacagaggagctgccaaacatatttgaatttaatgaaagtgaaatagcacaatttgtaaaataaggattaaagacataaatgaaaaagaaaaaaattttcaaactaatttcaaaaacttatttagaagaacatgatgcagaaggatattattttaaacatgagagtggtcttgaagtatttcacttaaaaagcgattcttttaaagaaaatgcattttgcatagctttcaagacaataccttcaaacaatactggagttgcacatgttttagagcacacaattttttgcggctctagcaaatataaaataaaagatccatttctttacctattaaaaggaagtctaaacacatttttaaatgcaatgacattcccagataaaaccatctacccagcagcatcaacaattgaaaaagactattttaatttatttaatatctatgccgattctatatttaacccattgcttaaaaaagagtcatttatgcaagaaggatacaatataaatccaaaagattttaaagtatctggaattgtctttaatgaaatgaagggtagctattcaaataaaaattctctaataaatgaaatagtaagcagttctctttttgaagagggtgcatataaatacgattcaggcggaatcccaacaaatattattgatctcacctatgaaagttttttagatttttataaaaaatattatacacttgaaaactgcaaaatatttttatgcggcaacactcaaactgaaaaaaatctaaatttcattgaaaaatacataataaggccttataaaaaagaaaaaagcaatgtcaatattaacatagaaaacgttaaaagatgggaaaaggggaaaaaattaacatataaaattcctaaagaaaacgataattctcttggggtatacacaataaattggctttgcacagaaattaataatattgaagacagcattggtcttgagattctctcagaaatactcttagacgattcttgttcattcacaattaatatcttaaaaagtgggataggagaagatatagcccacattagcggaatcaatacagatttaaaagaatctattttctcatttggactccaaaatgtcgttgaaaacaaagaaaaagaatttaaaaatctagttttcagtgagcttaaaaatttagtaaaaaataaaattccaaaagaattaataaaaggaattctttttggctacgaatttgctttaaaagaagaaaaagggcaaaattttcctatcgctttaatgataaaaagtttcaaaggttggctaaatggactacatccaatcaaaacattacaaacaagctactatataaatgaaattacaaataaattggaaaaaggaatttattacttcgaaaatttaattgaaaaatatctaatatttaataatcattatacattaataagctttattccatcacacgatacagaaaaggaaatggaagaagaaattgaaaaaaaattgatggcaagggaaattgaaattaagcaaaatccagaagaatttttacaatttaaaaaagactacaatcagtttaaaaaataccaaaataaaaaagattctaaagcagatatagcaaaacttcccttactaaaaatagaagatttgccaaaacaaatagaaaaaagtttggatcttaatgaaataaaagagctaaatctacattcttttaagtttaagagtaacaatattttcaatgtaaatttattttttaaattagattttttagaaaaagaagattacatatacctatctttattcaaaagagctcttcaagatttatctacaaaaaattattcttacataaacattaacaataaaatccaaaatactttggggcaaataaatatatctgaaagctacgacgaggatatcgatggaaacattttaaattcatttaacattagctttaagtcttttaacaataaagttaaagaatcatttgagctgataaaagaaattttaattaatattaactttcatgattatgagagattaaaagaaataacactaagcttgaaaaatgattttaaatccttattaatccctaagggacatcttttagcaatgttaagatccaaatcaaaactaaaattaaatgagtatttaaaagaattgcaaaatggaataacaggcagagaattttggcaaaaagcaaaaaccgatacagaatctttaaaagaaatcgcaaataaattagacaatttaaaaaataaaataattttaaaaaacaatctatctgcactaataatgggaaatactgacgacattcttaaaaacttagaaaatgaatttttcaatctaaaagaaagcctagaagagagcaatcattacaacgggttgctcaatcttgacgcaaacagcaaagcattaagagaaataataattatccaatcaaaagtagcttttaatgctatatgtttccccagttacaaaatcaacgatgagaattatccaaaagcaaattttctagagcatgtattaagaagtggaattttttgggaaaaaataagggtaatggggggtgcatacggagcaagcgcatcaatcgccaatggaatcttctcttttgcgtcctacagagatcccaatttcaccaaaacttaccaggctttcgaaaaatctttagaagaattagctaataataaaatgacagatgatgagatttatacctatttgataggcttaataggaactaacatctatgtaaaaactaaagctacagaagctttgcaaagctatagaagaaaaatgctaaatattagtgacagcttaagacaagatattcgaaatgcctactttacaattacaccgcaagatattaaagaaatatccacaaagattctaacacaaataagacaacacaacagcattgcatctttagtaaataaccaaatatacgaagaagaaaaaaacaacctagaaaaattaataggaaaagaatatagcttaaaaaagatttattaatattttctcaaaattttatacaaaaaagccaatttttaggactttttataccttttattaaatttatcaattcttcctgctgcatcaacaaacttttgctgaccggtataaaaaggatgggatttgcttgtaatctcaacagtaaccaatggatattcctttccatcaatatatttaatagtttcctttgaattcaaagtagacttggttaaaaacattgctccatttgatccgtctttaaataccactaaattatttttaggatgtatatcttttctcataaaaccttcctcttaatcttcaataaagtttaatttacattagaaataatgtcaatttattcaattaccattgctcattgtcttcaagaaaatttcattgtttttgctttttttcatcttttctatcagaacttcaactccctcataatcatcaacacctccaagtattcttctaataagcaaaatcttagaacgctcctcttcactaagaagcaattcttcttttctggtacctgactttttaatattaatagcaggaaaaagtcttctgtctgccaaacttctatcaagaattaattccatattaccggtacttttaaattcttcaaaaataacttcatccattttactaccagtatcaaccaaagcagtagctataatagttaaacttcccccttcttctatatttctagcagacccaaaaaacctctttggcttatgaagagcattagaatctaccccacccgataaaattttaccagaagttggcatagtttgattatatgcccttgcaagccttgtaatagaatcaagcaaaataacaacatcttttttgttttcaacaagccttttagccttttcaataaccatctctgctacctgaacatgcctactagcctgctcatcaaaattagatgcaattacttcgcctttaacgctacgaatcatatctgtaacttcttctggcctctcatcaataagtagtatcattaaaataacatctgaataattagtagttattgcattagctattttttgaagcagggtagtctttcccgcttttggaggagaaactattaaagccctttgccccttacctataggtgaaaaaagattaataagccttgtagaaatattgcaattttcatattcaagattcaatttcacattgggataaagaggagttaaattatcaaaaggtattctgttttgagcaaacgtaggatcttgatcattaatagatttaattttaaccattgcaaaaaatctctcaccatctctaggcgatctaatttggccatataaaatatcacctgtccttaaattaaaaagtctaatctgagagggagaaacgtaaacatcattgcctccagaaagataagaatttgatgcagttctcaaaaacccataaccatcactaagcacatcaagcacacctgtaaataaaacatcaatattattctcacttaatattttcaccaataaaaatattaattcggtttttttcattgttacagcaatagtatgattggtcccaagaccttcaacaatttttctaacctctgtaattggcttatcataaagtttttcaatctctacataatctttaccattaaaaaatttgatgatattactttgctctaaagttttaatattattttctaaacctgaagaaggaatatcataatcaaaatcagaaaatattaccccgtttgaatcctttacgccacttaaatctgcagattttgtcacgctagatgcagaatcctttttagcaacaactttaaccactttttttttcaaattatcttcaatcttaaactctttagaaacatccaaccgccttatttcactttctaaatcaaatccaccattttttttatccatattttcctctacgaattaaatttttaagaaaggattttataaaaatctacttattattaattaataaaaaacactgaccctattgcaaagtatcttttatttgtgaaacggtgaaagaaaataaatctacaatttcattagactttatcatttcacacttaccatcaaaaattatattatcattaataaatattttttttgtttttacatccccatatattttacaaccgctgtttaaataaaccttactagcagcatttacattgcccttcaaaattccttctactattaatgtatcacaaattaccacattggtaataaccttactattcttgccaataaaaagcacacccccttttgaagatatttcaccttcaaaagaagaatcaagatacaaagttccttcaaattttaattttcctctaaaagttaaactggagtctagcttacaatcccatttataagaatctacgatattaaccggcatttaacctttgataccccacactctctctttcaaatctttgcctggacgaaaatacgcaacgtgatgatctaggaccttaacatactcccctgtttgaggattgcgagcatttaagcgtccctttctttttctaacttcaaatgtaccaaaagatctaaactcaataacattattcgaacaaagattacttttaagctcttcaaaaaaagcatctattacaagtcttatgtattttttttctaatttcagattattatttttaatattcaaagatatttgatcaacaatgtctgacttagtaacctttggtcttcttgaaaaagacataaactaatttccttactttaacagcaaaacatttaaacgagatttttttctagcagccttatttttatgaattattcgctttctagcagcagtgtctagtttttttgcaacaaatttaaaaaattcaatagcttcgtctttcttacccgcttttatcatgttgatacagcgtttttctattgtttttaattcactttttacacttacatttctaatctttctttttaaattttgacgagagcgcttcaatgcagatgcattttttctcaagttatactccttaataatattattaaacaatagctttaatatatcaactaattcaaatatagtcaatcaaagatttaagttaatttagtacaatagttttgattaatatattcaaaaaccttttgcatggaataagaaatttttttattcaaaatatataccttttttgtctgatgattttctttgtataaaaagcataaataatttttattgttaaattcaaattctctggcaataaaaattttttcaaaaaattcataaaaataaatttcacttttaaaaatttttctttcacagattgaatctttcctaaactcataaaataacactatattgctaataactgaaaaatcccccaacaaaactttaatatcaataaaacaaataaataaaaaaataaatatattgcttaatgaaatgtaataaacaaataaagcaatcataatacgagctaaaaacataaaaagataagtacaagataaataatatcttattggaaaattttccaattttgggacaaacagatcttttctcttaattttaagctctttaaataattcacttgaaccgttgcctgtccaaaaacaaaccttaatcttttttttattttttaattgcaaaatcaaaacattgtctgataatcttttttcaaacgaaataatatcactaaaatcaaaattataacttaaaaaaatacccttataataaatcttagatcccttaaaagaaatagaataaaaatatcttaaataaaaaaaaattacaaaaaaatttaccaaaagaagtgctaaaacaaagtaaaaaaaacttgcgtcataaaaacccaaataaagcaaacaaatcacaacattaaaaacaaacaaactaattaattttacattattaaaaaataaatcacgcataatataaaaataaatctacacattaaatttaaaaaagattacatctccatctcttacaatatattctttgccttcaattctaacaagtcctttctcttttaatttttgaacactttgaaatttaaataaatcctcacaagaataaacttctgctttaataaaacctctctcaaaatcactatgaattattccagcagctttgggtgctctcatgccctgcttgaatgtccaagctctaacttcttgcaaacctgctgtaaaataggttctaaggcccaaagtataataggcttttttaattaaattgccaagaccgctatcatttattccaaataattttaacatttcatttttataagatatatcctttatttgggcaagttcagcttcaattttggcacataagattaaaaaatcatttccttctttcaaggcaatattttttacaatatctgtatatttattgccgctaagtgaattttcatcaacattgcaaacatacaaaacttttttaaaagtcaaaagatttaatgatctaataaagttgtattcaaaatcatcaaatttaaactcaacagcaggattcatattgcttaaatggtcttcaagtctttttaacattaaaacaattgccttagaagattcactaattttcttatcagtgcttttggcatttttttcttgtttttgaaggcttttttgaacagtttcaagatcagatagacaaagctcaacattaattgtagttatatctttctcaggattaatatcgtcattaatatgaataacctctttttcttcaaaacatcttacaacatgaacaataagagaaacttcgcgaatattagccaaaaatttattgccaagcccttcgcctgttgatgctcctttgacaagacctgcaatatccacaaattccataacagcaggaataattttgcgtggaataatgcactctgagatttttaaaagcctttcatcgggaatctctactattcctatatttggctcaatggtacaaaaaggataattcgcgatctcaacattagatgatgtcaaagatgaaaataaagtagatttacccacattgggaagtcccacaatccccgcattaagtctcatagcctaaacctctaataaaatcaaaaagaaatctaattaataaaatatgcaaactcccctcttcctgtctgttgatttatatttgcttcaacagataaattaaaatatttattaggttcttgagggcctggataataatattccaacaaataagtgcccgttttttgttctaaaattaaatcataaactttagatacaccttcataagatgaaaaaggaattacagcaccgcctgtttcattaactaaatactgaagcttactattaataggatcattaccaaatagtattaagtaaaaccttatatcattatttttataatagcttactattgtatctaaagagtacttttcaaaagctttacgatttaaaataccaccactaaaataaactactgctcttcttgagctttttgacataagcccagaacctgccaacttcaaactaacgtctgtttttacagcatctgtactataaggaccaagagaacttgtatttctaatgctatttgttaagctttcaatattatctataatgggcacacttgttgcatttataaaactaaagtttttattttttgacaactccattagggcatttaaccctacaatttgatctgtatcatattttttcatataagaagatttatcaaaaacaactgctatattaatgtcttttgaagcatttacattatatgccaccttgggattgacaatgtaataattttcatttgaaattgaaaaattttcacttttaagcccaacaactggtaatccgcttttactgctaacattaagctcaacgtaaattttaggccctccaagcctaattattcttctaacatcaacatttaaactatcataaaggcttgcatcactcttgtaaactgaaaccttggcattattaaaatctgagacaatcatctgattattggcatccaaaatagatgaagaaattttagaattcattttatctgcttttaaaatttttgtaattgtctttttagcaatgctatatttataaacaccatcttttgaggatactataacattattacctacaaaatcactgctaagcccctctattccctcaatagaagtaaaaactgaatataaatgattaccactagtatcaaaaacttcaatggtatttctcagagaatctgcaacataaatgttttcattcaaataagtaacgcctgtgggacctaaaaggcccttatagcctgaagttctagaaccaaaatgcaaaataaaatcaccttcaagtccaaatttacttactcttttatttccccactcacttacataaatatagtttctcttatcaatagccatatactgaggagcaagcaattcgccatcttttgtgcctttattcccaatagatttccttttaactccaagaactttgtcataaacaccaatttcatcacttgaataaagagtcacataaagcagattattagcttcaataacatcataaggtgattttaaataactaaagccatctttaactaaagcattaacattgttattaacatcaaaatacaatatttcattgcctacaaagttagcagcgtaatatccgccgtacttatcagcccttaaagatgtaatctggtacccatgtggccttttataaatagaattatcaagagaagcaacttttacaagttttttaaaattaagttcataatttgaaaaaatacctctcctttgctcaatagtagaaatcaaatgtctaagatagggaaccttatagccttgatcttttaaatttctccattccattaaagcttcttcaacataacccagtctataataaacattgccagtccaaaaatgataatcaagattattaggatcaaagcttaaaatttttttaaaagataaaagagcatcatcgtaaattccattattataagaattaagagcccatttaaactcttcttgagcatctttattagtaactattccttgggcatgcaaactaaaaatatttaaaaaaaacaaaccaataaaaccaaaaattaacataatcccctttactctttaaatacctattataagcataacttttccaaaaaataatacaaaaaaattaatactatcatataaaattattaatgataatgttaaatatattacaccattatgttactaataatagtaaaaaagaggaaaaatgaaaactagatgcttttgcttagccgcattttcaggaattcttacaacacttgcaattccaaatgaaattaaagaaaccggatattcaatccttggatttgttgcttatgtaccactttttatagccttaaacaaactagaagataaaaaagcattaatgggactgacggtattttactttataatagccaacagcctgcaaaatttttggcttgggttttttcatgcatttggatggattacattcattggagtgataatagggtacattccatattcactaactttaggctatttcctttattactctttaaaaagctttaaaaataaaacgatgagcataacaatgctttttacattttatgattactcaagatcaattggatttttagcatatccttgggggcttgcagctttcaccgtaaataacttcaacaatttaattcaaatagcagacatttttggtgtattttttgtatcatttgcagtctactttttaaactcgggaattgcagactttctaatccacaaaaacaaaacaaatttgctaaacatagcatttccaacattgctaataacagcatcttttacttacggaatgatcaaaaaaattgagctaaaaaacttattagcaaaagaaatagacagtctaaacattgcagctattcagcttaacactgatccatggttgccaggaaatgacaaaaaaggaataagagactctattgaaattacagagcaagccttaaaagaaaatccaaaaatagaatttgtaatctggagcgaaggggtgctaacttacccttttagcaaagaagatcagcactttaaaagctctgatttgcacaatgagcttaaaaattttataaaagaacacaaaatcccatttgccattggggctccctcaaatttggacaaagccatagggattcaacaaaattctatttatatggtagaaccaaacctcaacattacaaacatatattccaaaatattcttagtcccttttgcagaaaaaattccattttacgaatataaatttgtaagaaacttttttttaaaaaactttagaattttaggacagattgaaggaaataaaatcgaaatattaaaattgaaaaagtttaaatttgctcctttaatatgctatgatgatgcatttccagagctttcaaggttttacaaaacccaaggcgctaatatattagtaaatttttcaaacgattcttggtcaaaaacaaattcagcagaatggcaacactttgttgtggctaaatttagaagcattgaaaatggaatcaaaactattagagctacaaactcaggaattactgcaaccatcaacgaatatggagaaaccattaaaaaattggaaacttttaaaaaaggatacctattatcaaccgtaaaactgtccccaacgtttacaaccatttatgaaaaaattggagactcgtttatacatatattagtgatgatgtttttaatcacaacactaagatttcaatttatggaagacaaaaaccaattattatcatcctctgtagtaaaaattaaagtttgacgttctttccaaaatggaaaatttttagtaacatcattttttttggcattaacattaacagcaaaagaagtatcgttggattttgaaatttttaaagactttaaatcgtaataatcatcaactgataaatactctaactcatcagcatcggccttagatgaagcacttgataaagttgatataaaatcattttttgattcaaattgacccataacgttaactttatccgcaataactgaatcaaacaaatcaaagttcctagaaattaaagctcttgcaaactttccaaattgaaacttaataattttatcttgatttttgcttctctctctttgagcaatatattctattttaggagcatttgtaaaatcattgatttctattttttcgtgcactattccaggtatctcctcaagcttaatatcctcaagcataacaaccttgggattgtcatctttaatcctagcatcaagctctttaactgcaagcttgatatcaaacccctttttcaaatctggataaatctttaaagcttttgcttgaaaaagctttccttttttaattttaccaacgtttatatatctttgaccaacctcataataaaaaatagcaagctctttttgcttatcaatataagaagaactaccttgagcaaataaattcaaaaaaacaaaagaacataaaatatatagaagaaataatcttctcataagaacctccattaacactcaaccttaaaataaaacaaaagaatgtcaatctactataaataattataatacaagtttatctctaattaaagaaatcactttattcctatcttcttcactaaaaatatttatattatcgtaagaaaattttatttttgacgacaagttgtattcatcataccactttaaatatttcctattaagaccctcaagataatctctggggatattcatttcaaagcttctatttctatttttaattctgcgctcaacttcatcaatactacaatcaagataaacaagcaaacttggtcgctgagaatgttcaagcatattatcaagaagatcgatatatattttatattcctcatcagaaatatgcccatcacaatttaaaagagacgcaaacacacaatcaccataaatagatctgtctaatatgcccccttttgttctaaatacaccttttattaatttaaatctctcattaagaaaattaatttggactggaaatgcccatctggatttatctttataaaatttgtctaatacagctaaagtaaaatcattattcaattcactgtaaaaaggaacttccaactcctttgataaaatatttccaagagtagtttttcctaccccaattaaaccttctattacaatcaccaagtctacctccaaaataacttaaataaattcaaatataagctaaaaaaaagaactactaacgaacaaaacttcattaatgaaaaaatccaatgtaaaaattttaatataaaacaaaaaatccttaaacaaattttagaaaagaaattcataatttaaaaattaaaattcttaaattattgacattaatcttaattaaaaataagatattaaatataattttaataaggcttttattagaaaaattaattttttttaataaaagagactaaaataaaaaaattctaaccatcttgcaaaaaacaaaataaaatttaattaaaagatttaatattattcagattaaaaaatcaaaaattaaaacttcttaataaaaaataaaatagttataaagataaggagatataattatgaattatacaaaattccaagaatttatatcggaatttttgggaacatttatcctattggctctaggaactggatctgttgcaatgacagtattattttcctcaagtcccgaaataccaggagaaataataaaaggaggatatacaaatatagtatttggatggggattgggtgtaacgtttggtatttacacagcagcaagaatgagcggagcacacctaaacccagctgttagcataggattagcaagtgttggaaagtttcccgtttcaaaacttttacattacattgtagcacaaatattaggagcttttacaggtgcattaatgacacttgtcgtattttatcctaaatggatagaaatggatcctggcttagaaaatactcaaggaataatggcaactttccctgctgttcctggatttttgcctggatttattgatcaaatttttggaacttttttgctaatgtttttaatttctgttgttggagattttacaaaaaaacacagcgacaatccatttattccttttattgtaggagcagtggttttatcaatagggataagtttcggaggaatgaacggttatgctattaatcctgcaagggatctgggaccaagaattttactcttatttgctggatttaaaaatcacggatttaacaatctaagtatagttattgtaccaataattggcccaataattggagcaattttgggagctacaatttacgaatttacactaaaaaataacaaagactaaaagaaaaaatatttatctttattaaaggaaaaaggaaaaactatgaaatacattttatctattgatcaaggtactactagctcgagagcaatggtatttgataaaaatgcaaacataaaggggtttgctcaaaaagaatttactcaaatttatccacaaccaagttgggtggaacatgatcctacagaaatatggggctcacaacttggagttataacagaagctatggcaaatgcaagaattttgcccaatgaaattgacgctattggaataactaatcaaagagaaactacggttatatgggaaaaaaatacaggaaagcccatctacaatgcaatagtatggcaagacagaagaactgcaaaaatttgtgaccaattaaaaaaagaaggaaaagataaaattattttggaaaaaacaggcttggtgctagattcttattttagtggaacaaaaataatgtggatattggataatgtagaaggtgccagacaaagagccgaaaatggcgaattatgctttggaacaatagatacatggatattgtggaacctgactcaaaaaaaagaacatgcaaccgattactctaatgcttcaagaacattattattaaacattaaaacattagagtgggatgatgaacttttaagcatattaaatgttccaagggcaattttgcctgaacttaaagaaagttctacaatatacggcaaaacagacaaagcactatttggagcagaaattcctattgcaggaattgctggggatcaatttgcagcaacatttggacaagcctgccttaaaaagggtatggccaaaaacacttatggaactggctgcttcttaacggttaatataggaaaagaaccaatcattagccacgacaagcttttaacttcaattgcatggggaagaaaaaaatctgtaacctacgttcttgaaggaagtgtttttattggaggagctgtaatccagtggttaagagacggtcttgaatttttcagaaaaagctcagatgcagaagcgttggcaagctctgtctcagataatggtggagtttattttgtgccagcatttgttgggcttggtgcacctcactgggattcttatgcaagaggaacaatcatcggaataacaagaggctcaacaaaagctcacattacaagagctgctcttgagagcatcgcatttcaaagcttcgatatactaaataccatgaaaaaatccattcccaactttgaaattcaagaattaagagtagacgggggagcaagtcaaaacaatctattaatgcaatttcaagctgatcttttagaatgtaaagttgtaagaccaaaaataacagaaacaaccgctcttggcgctgcttatcttgcaggacttgcaacgggttattggcaaagcgccgaagaaatcgtaagcctttggcaagtagacaagatatttgaaccttcaatgccaaaaaatcaaaaagaaaagcttcttgagaattggaacaaagcggttggaaaagcaaaatcctggatacagaattctcatagttcataaaagttcaaaacaaagctttaagattataacaaaaatatactggtaacaaaattatgcataatttatttgattttttgaaactaaaacaacatataataaaaatgtttggcaagcaaataaatcaattatacaaacagctcttaattaaattttttcatctacatctattaatattgtgcatgtattcaaaaaataaactgtctaaaccttttgaaaaggtaaaattcattggagcaatacaaaaaatgattaataatatattaaatctaaagaaaaatcacaaaaaattgaaaaatttaccagtgcaattggtctatagtgctattcaataaaattaaaacaaatggtcttttcgaatttcttcaatctagtatttaactaaaaagaaaagaaattaaccaaaatggaggaatatttaaatttcatgaataataacaaagaaacaaaattaaaagatcttgaaaatcaagaatttgatcttataataattggagggggcgcaacaggtcttggcattgcggtagacgcaattacaagggggtataaagcaatacttatagaaaaatttgattatgcaaaaggaacttcctctagatcaagcaaattaattcacggtggagtaagatatttagcccaatggaatatttctttagttaaagaagctttgcgcgaaaaagccattcttgagaaaaatgcaccccatttaattaacgaatgtgcacttatcacgcctatttataatgttttagaaataccttattattattttggattaagttactaccacaatcttatgggtaaagaaaaaactactaaatacaaaactaaattactatccaaaaaatctaccattgaaaaagctcccaatattaaaacagagggccttaaatgctctgttctatattacgatgattcattcgatgatgctagaatggcaataacattgttaagaacctttaccgaaaaaggaggcattgcccttaactatacagaacttaaaaaattcaacaaagaaaacggaaagctttcgggagttcttatacaaaataaattgtcaaaagaacaaatttcattaaaaagcaaatgcataataaacgcaacaggaatattttcagatgaaataagaaggttggatgatgaaaaagccttaaacatcattaaaccttcccaaggtagccatttagtagtcaaaaaagacaaatttcccaaaaatcatgcaatattaatacctaaaactagtgataataggattttattcgctattccttggtatgatagtgttgtttgtggaagcactgacattccaataaaagagatagaagaagaacccaaaagatttgaagaagagattgactttataataaataatttaaataactatttaaatattaaaatagaaaaatcagatgtaaaaagtgtatataccggaataaggccattaataatggatccaaaagctcaaggaaacacttcaaaaatctcaagaaacgaaaaaatatttatatcagattcaaatcttattacaatagcgggggggaaatataccacatatagaaaaatggcagaaaaaaccttgcttaaggccatagaacaaaatttaataccaaatcgtgcaccaactacagaagatttaaagttgcacggctaccttaaaaaagaagaagcaatgaaaattcctgaaccttttagagcttatggcagcgactttgaaattctaaaaaatatggagggttttgacaaaaaaatacacgaaaacttggatttaaatgaagctcaaatagatttttcaattaaatttgaacaagccaaaactattgaggatgttttagcaagaagaacaagatcactacctttaaatcctcaagctacaattgaggctgctccaagagttgctgaaataatgatggaaaaattaaataaatctgaagagtggaaaaatgaacaaataaaaaactttttagaaataagtaaaaaatatttaatttaaaattaatttttatattaaacaaagggattgttaagcaatcccttttaattttaaaacctaaaacattaaaaagtcttacacccaattcacattagcaaattcacaagcaagccttgaatctcttcaatgctatccaaaagtttaatctgagtcatttgattttgtaaaacagaataagcaagtttgtctaacttgtcgttaataatcttaataattctatacttggggcgcttgggatctcctaaatttccccctttttgctctttcaaacaaacagaagatgatataataatggatataaactctgaaataacttttttgtaaaaaataacattttgtctggaaggctcactcaaaagtctctcaccagtctcattaattccatctaacatacttttaattaaatcaagattaaattctccattttcaagtaaaataaaatgcttatcctctttgacactttcagcctgaaatatcgaagaaaaaagattgttcttatcaaaagacacctttttgccactttttttataatcttttgaattaagatttaatgccccagcaattaaattatttactttcatctattttgttcacaacacttgaaaaatatttatcatctttaccttctaaaagttgaaaagactttttttcttcttgatgcaccttattgatttcaattaaaagatcttcattaaccttgtaagaaccagtataaaaaaatgtatttctttcaggagctctaagatactcagcgccaatatccatatacccatcaataatagcgccctcttcaacttcaattgacttacaagaaatatttccaataacacaccctgatgcaaatattttaatcttgcttttagcataaatattacccacaaccattccagaaataacaagttcattagcatcaatgctagatttaactctaccactctccccaataattactcttttagtagagctaatggtgcctataaaatcaccatcaagccgaataaaattatttgaaactaagtctcctttaaaaaaatcaccaacgcccactattgtttttatttcatcaaaaataaacaaagacggggcttttctttctttttttacagtcaaaaaatttaacatctattttgaagctcctgttgctaaatttaaatacatatcgggattaataacttgagaacctacacgaacctcataatgaacgtgtggacctgttgcataacctgtctgccccataaatccaattatctgcccctttttaacataagaccctttagaagtattaagccgcgacatatgcgcataaagagttgcaagtccatacttatgcttaatttgaacaaaattaccatagcctgctgactgataacttgccctaacaacttccccatcagcagttgcaacaataggagttccaattctgactcccccaagatctatgcctttgtgaatataccattgcctagtaaaaggctcaatagcaggaccaaaatgcaaagtaataattccagatccacccgcaagaggccaaagagaaggaatatcatttaaaagcttgtcttgggcgtgcaagactttaactatgcttttaagaggaggaattgaactttctattttgcttttaatatttttaagatcactaagctcttttattgaattagcttctaaaatttgcaaatcaataaaatcagaaagatctccatctagtttatttttatttaaatcaacaccattagaattgatttttaaagaggttttaagttcatctaaaactttagaaaaattttttgcaacagaattaatttctacaactgtatttctaaaatcttcaatctcagattctgctaaagagtaatttttctctgtagacttcacaattgatgagagagtaacgtaattaacagcaagtaaaacaaaccctataaaaccgcctaaaaaaaaagtagaaaagaaaaataaagtcaaaaaagaaattttaatatttttgacattccctttaacatggggaataacaataaaactaatattttgcttaaaaaaagaatgtatggctttaagggctataaacaaagaattataaataactaaaaaaaactttaaaattcctttaaaacccaaaataatcttaaatctaattcttttcttcataacaaaccttactaaaaattaccatgatcaaacaagaaaattaaaaatttattttaacaccttagacaaaaatccaaattttttcgataaaaacctggtacaaaaatacttaataagtacacaaaattaaagagaataatacttaaaaccaatataattatacaattaaactcataaatactttattattatatagatgaaaacactattttttgcaacaacaaatgaaaataaaataaatgaagtaaaaaatatattagatatacctaatttaaacttaatagtccctcaaaattttaacataaaagaaacaggaaaaacatttaaagaaaactctttacttaaagcaaaagcactgtttgaaattttaaataacaatcaaaatgttttcggagaagattctgggctgtgcattgaggcactaaacttggaacctggaatttactctaaaagatatgacacttataagctatgtaaaaaattaagcactaatgaaaaaaatcaactaattttggacttaatgaaaaatgaaaaaaacagaaaagcatattttatatgcaacataagctatatatcaaaaaatgggcaaatattaaattttgaaggaattattaagggaaaaattgccttaagtttaaatgacaagaaaaactatggatttgggtatgattcaatatttttaactaaaaataataaaaagcttagtgatctaacacttgaagaaaaaaacaaaatatcccacagaggaatagcatttttaaaatttaaaaaatttttactaaaatctttattcaatagttaaacttaaaggctttttatatataaagtttagactttattgtaaaataaaaagcacaatgtttataaaatttcaacttattatttcttttcaaacaataaaaaaaggaagaggagaatttagtgataaatagaaatgaaatcaatgagaatgataaatgggatttatcttttctatttgcaaatgaagaagaatatgtaaaaacaatcaatgctattgaaattaaaaccaaagaatttaaaaaatatgaaaaactggaattaaattttgatttatttaaagaaactttaaacaaatactacgaaatcatggaagatttagagaaagtctcttactatgcaatgcttcaattagaaacagatgtaaccaataaagattcaaataaaatatattccatatgtgtcaatttagctacaaaagtatctaatactacctcatactttatgcctaaaatactaaaaacagacgaaaaaaaaattcaagcttggataaatgatccagagcttaaggataaaaaaattgcaattgaaaaaatactaagagaaaaaaaacatattttaagcgaacaagaagaaaaaatacttgctaactacacccccctttacacatcttatcaaagcatattctcagcattaacaaatgctgatatggaatttggagagatcaataaacaccctttaaccaattctacctacacactatttttacaaaacgaagatcaaaaaatacgaaaagaagcctttttaagattttatcaaaaatacaaaaataatgaaaatacgcttgctaatcttattatttcagactttaagaaaaatcacttcattgcaaagacaaggaggttccaaaatactttttcaatgcagctcttttcaaacaatattgataaaaaagtttatacaaatttaatcgaaactgtcaatgaaaatttacctgtgcttaatgactattatgagtttagaaaaaaagtcttaaaccaagaatatctatatcactacgatgtttacgtaccattaacaaaaggaataatatttaaaaattcatttgaagacgcttgtgagaaaatattaaaatctttagaggtactaggaaatgaatatacaaaaatcttaagaaacggtcttttaaaagaaagatgggttgataaatacgagaatactggaaaaagatcaggggcttttagcgctggatcatacaacggaaagccttatatacttcttaattacaaagacgaatcaataagagacatgtttacgcttgcacatgaagcaggacattcaatgcactcttactttagcataaaaaacaacccattcccacactataattattccatttttgaagcagaaatagcatcaataatcaatgaacaaatattggcagaatatttgcttaaaaacgaaaccgatactaacaaaataaaatatataaaactaacacaaattgacgacatgatttcaacattctttagacaaacaatgtttgctgaatttgagtacattattcatgaaatgattagcaaagaagaacctgtagtaaaagaaacactaacagaaacttatatgaatttgttaaaaaaatactttggacctagtctaaaatttgatgaattaagtccccttgaatgccttagaattcctcacttttattcacccttttatgtgtatcaatatgctacaggcattgcagctgctctgtcaatatataaaggcattaaagaaaataaaaaagatgcagtagaaaattatataaaatttttaaaaacaggtggttctaaatatccgctagattccttaaatattaccggagtagatttaacaaaaaaagcaacaatagaaaacactattaacattttcaaatgcagacttgaagagataaagaaaatattccaataaaaggagctttactgtgaaaaatatcaatttgattttagcttggcttgtacatatttttacagcatctggcttgattgtaggactttactcaataatttcaattgtaaacggtaattattctcttcttttaaagttaacagtaatagggcttatcatagatggaattgacggaactatggcaagaaaacttaaggttaaagaattaatacccgaaattgatggcactctacttgataatattacagactatataaactatacattcatacccgttatatttttttatttaggagaatttattgaagaaaaatataaagtcgccatttgcatcggaattttactctcatcagcataccaattctcaagaacagatgcaaaaacaaatgataactactttaggggatttccttccctatggaatctctttgtgatattaaacataatctttaaaatggaacaaataacaaatcttattacaatgtcaatatgcattataacaagctttattccaataaaatttatttacccatcaaaaaccaaagaattaaggaaaattaccataccaataacaataataagttgcctaatatttgttgtatcaatattttcagagctgtccacaacagcgttaaaaatggcaaaaacggttcttatcctttactttgcatatttaactttagcaagcatatatttaacttataaaacaagaaatagatgacaaaaatgtatataaacacaataatagaatatattgattcaaacatagcttattccccaatagtatttttttcgttactaattttagcaggacttaatgttcctatttctgaggatgcaatagtactaatgggtggaattttatctagtcgaaaaaatgaatatactatattaatatttttaggaattttttggggagcctatcttggagacataatatctttttacattgggaaattaatgggaaataaattatttaaaaacaaaaaagacaataacctgcttgacaaaataaattactattatggtcaatatggggtattaactttatttataggaaggtttataccctttggagttagaaacgcaatatttatgtcagcaggaatgggaaatatgaaatctaatctatttattgtttctgacttctttgcaactttgctctcaatagttgtttattttactctaagcttcaaactaggtcaatcatttgaaataatattttcaaaaataaaaataattatatttgcaatatttatcgctgtaatagcaacaacaataataatctacgtaattaaaaaaaataaaaaagttgacaaaaatttaaaataaaaaatataatggttaatagtgctgtggtggtggaagtggtagacacgctagcttgaggggctagtgggcgcaagcccgtgctggttcaagtccagttcacagcatcaaaattgttagcaaattattaaataaaattaacaaaaatgcaatctaaaagaatattagagaataagttgttatgagttaattttcaagaggacaaatgtctaaatacgaattcataaaaattgaaaaaaaatggcaagaattttgggataataacaaaacatacaaagtagaagaagatccaagtattcccaaggaaaaaagattgtatatacttgacatgttcccctatccttctgccaacgggcttcatgttggtcatccagaaggatacacagcaacagacatatttggaagatacaagcttttgaatggatttcatgtacttcacccaataggatttgatagctttggacttcctgctgaaaattacgcaatacaaacaggaactcaccctcaaaaaagtacagaagaaaatattaataagtttaaaaaacaaataaaagctttggggtttgcctatgattgggatcgagaaattagaacacatgaggagaattactataaatggacacagtggattttcctgcaattatataaaaaagggctagcttatgtaaaagaaatgcctgtatggtactgccccgagcttggaacggtactagcaaatgaagagattattcaaacttcagatggaccaaaatctgagagaggatcttacagcgtcgaaaaaaaatatttaagacagtgggttttaaaaattacaaagtatgctgaaagattgctagacgaccttgaagaattagaatggcctgaatctgtaaaagaaatgcagcgaaattggattggcaaatcaacaggagttgaaattgaatttgaaattgaaggccacagcgataaaattaaagtctttacaacaaggccagacacaatctttggcatcacatatttagtgatcgcaccagaaaataaactaatagaaaaaataacaaagaacaactttaaacaaaatgttttaaaatatgtaaagcacgaagaactcaaaagcgatcttaataggacttctcttgaaaaagataaatcgggagttttcacaggatcttacgcatttcatccaataacaaatgaaaaaattccaatttgggttggaagctacgtactaggaacttacggaaccggagctgtaatgggtgttccagcacatgatgaaagagactttcaatttgccaaaaagtatcaattaaaaattttacccgtgatatcaaaatcggggaaaaatgaaatattagaaaaagcatttgttgatgatggaatttcaataaattctcccaatgaatttaataatcttaaaaattctgaagtaaaagacaaagtaataaaatggcttactaaaaacaaaaaagggaaagaaaaagttgcctacaagcttagagattggattttttcaagacaaagatactggggagagcctatacccattttgtttgataaacttggaaatgcaatacctttagaggaaaatgatcttcccttaaagcttccagaaattgcaaactataaaccttctggaacaggtgaatctcctttgtcaagaattaaagattgggtaaacgtaaaagatatgggctttacaagagaaacaaacacaatgcctcaatgggcaggctcttgttggtattatttaagatacttagaccccaaaaactcaaaagagtttgcaaacaaaaaaaaaattgaatattggatgccggttgatctatacataggcggagctgaacatacagtattacacctgctttactcaaggttttggcacaaggttctttatgatctaggatacgtaaataccaaagaaccttttaaaaagctaataaatcaaggcataataacatcattttcttatcaaaaagaaaacggggttttaatacccaatgaccaagttatagaaaaagacaataaattttttgataaaaaagataacaaagaagtaacccaagtaattgccaaaatgtcaaaatctttaaaaaatgtaataaacccagacgacattattaaggaatttggagcagactcaatgagaatttatgaaatgtttatggggccactaacagattctaagccttggaacactaaaggaattattggtgtttttcgatttttaaacaaaatttggaacttaagagaaaaagaactatcaaaagagaatcccccaagggaaataatatctgaactacataaagtaataaaaaaagtcacagaagacacagaaaaactaaattttaacacagcaatctccgccatgatgatatttataaatgaacttctaaagtatgaaaaaaattatttaaacatatttaaaccgtttatcattattttatctccctatgcaccccatttagcagaagagttgtgggaatatattggagagcttcctagtttattcaaaaattcaaaatggccaaaattcgatgaaagccttattattaaaggcaaaaaagaaattgtcttgcaaataaatggaaaaataaaagacaaaattttactaaacaaagagacaggcgaaaaagaactaaaagaaatagcaatggaaaatagcaaaataaaatcaaacttattaaataaaaaaatagtaaaaataattgtaattaaaaacaagcttgtcaacatagtgataaagtaaaaaagaggcgttatatggactttgaaggtctaagcattagatataaaggaattatattcacaatatttatcttaattactatttttttaggattttttttgaaaaatcttaaattcgatgcaaacatcttaaaacttatacccaagaccaaagaaactgaaagcttaatagacattgataaaagtaattcacttttatctacaatagtaatatttcaggataaaaaaaatatcttcaataaaaaaaattttgaaacaataaacagcgtaatcagtgaaataaccaaaattttaaaagtatctccaaatgccgttacaagcatattttcttatttcccacaatttaaaaaagaaatctacactgataaagatatagaagaaataaaaagcaaaataaagtcaactccatttgtaaaaaacacattcttaggcaactcagaaaatttaatatacttcataataatcccatcagagagtgaccaaatcaacttcagtagaaatttaaaaactgaacttgatgagatggaaaaaacaattaaaaaatatgaaactgacgatttaaagttgtatcttacgggggatttaatagtaagagaaaaaatcttaaactacatggttgaagacttcaaaatcttagggcctcttgctacttttgtagtaataatttcactctatcttattataaaaaatctaattggcgcattaattcctatttttattgcattattatcattgatttggacttttggaattaaagggcttgtacaatcccctattacagtgccagaaacttcaatgattgttttacttatttcaatcggatgcgccaatgctgtacatataataaatgaaatatttaaattaataaaaaaagaacagctctcaaaagaatccataaaagcaacaattaaaaaacttaaaacacccatcctgctaacatcttttacaactgcatttggatttttatctcttacaacctcttcaattaatgcctacaaaacaatgggtattttcatgtcaattggagtaattatytcaatgataatctcattaaccgttttacctggaataataacattaatcccatttgcaaaaaaaaagtcttttgaaaaagaaaaagaaaataaactaaataaaatatccttccttgaaagacttgccaaactaaatacgcaaataacaaaatctatattaaaaagaaaatatacatcctctataatggtcctcatcatactgggaatttcttttgtaggtcttttaaaaatcgaaatcaattttgatgaaaaagattactttaaagaaagcacaagtgtaaaaaaaacattaaacctaatgcaaaaagaaatggggggaatatcgattttcaaaatagaaattgaaggcaggcccggtgaatttaaaaatgctaaagcaatgcaaatattagacttaattacagataagcttgatgcattttctgcaaaaactcaatctagttctattaatggcattttaaaatttacaaattttaaaattaaaaaagaatccccactagagtataaactgcctgaaaataaaattatactaaacaaactaataaatttgatagataaaagcgattggactaaggacaataaaagaatgtacattaacgatgactggtcattaatatctatcatagtaagaattgaagacaactcaaccgaaggaataaaaaaatttgaaaaatatgctattaacacaattaatgaatatatgaaaaataataaatatcatttctcaggtgtttatgataaggtattaatagctaaaacaatggtaaaagaacaggttataaacattataacaactcttggatcaataacactactacttatgtttttctttaaatctataaaaaccggaataattattgcaatcccagtagcatggtcagtgtttttaaactttgctgtaatgagattatttgggataaccttaaaccccgcaacggcaacaattgcatctgtaagcatgggagtaggagtagattattcaattcattttttcaatacatttattttacaataccaaaaaaatcaaatctacaaaactgcacttcttgaatcaatacccaatgtatttaatggaatatttgcaaattctatttctgttggaataggatttttaactctaacattttcgtcttataaaataatatcaactcttggagcaataattgcttttacaatgctaacgacatctcttgcatcactaactcttcttccattattaatttatttatttaaacctagagtaaagctagcctcaaacaacaattttaaaaaattaaaacaataatttaatgacctcgcgcatattatctacaagataaaaattaattccgctcttaatgttagtaggaatctcttctaaatccactctatttgccttaggaacaataatatgctccacgccactgcgctttgctgcaattattttttctttaaggccccctatcatcattacattcccagtaagagaaagttctcctgtcatagccaaatggggtctaacaaccttattaagagcaagagagataaaagcactagctattgtaattcctgcagaaggcccatcttttggggtagctccttctggaatatgtaaatgaataatatttttttcaaaaaaagatttactaatacttaaatctcctttaatgctattaacataagtataggcaatattagcagattctttcataacatccccaagtctacctgttaatttaattccacccaccttggattccgtctttacagtctcaatcatcaaagttgaacctccataatttgtccaagcaaggcccattaccatccctgaatacatagcattaggcatgctttcttttctaaaaacaggcacaccaacatattcttctaaattgtcattggaaatttgataagatttaacctcagtattctcaataagctttctagcaacctttcttacaattttgtttaaatatttttcaaaatttctcactccattatctcttgcatactcttgagcaatttgaacaagagatgaactttgaaattttaaagaatctttatcaactccgttttcacttaaaactttgggaattaaatactttcttgcaatctctattttttcgttatcaatatatccagaaatttcaataatctccattctatttaacaaaggtcttggtattgtttcaacagaattagcagttaaaataaaaaatacattcgaaatatcaaaaggaagatcaagataatgatctctaaacctaacattctgttcaggatctaaaacctcaagaagaaccgaaaaaggatccccatagcttgaagcagaaatcttatccacctcatcaattaaaaaaacaggagaatttgtcttggtaattcttaagccctgaataatttttccaggcaaagcaccaacataagttcttctgtgtcccttaatctccgactcatcgcgcattccaccaacagaaaacctaaaaaacttggtacgcaaaacctttgcaatagctgccccaatagaagtttttcccacgccaggaggtcccaccaaaagaataatagcccccttttgagtctttcttaacttaagaacagaaatatattcaataattctatccttaacttcgttcattccgtaatgagttttatctaaaatttttttagatttttgcaaatctaatttatcaaaattaattttaaaatctcgccaaggaagctcagtaataagctcaagataatttctaacaacaatgtattcagccgaacttgtttcaagaagtgaaaatttttctaactctttttcaactacctctaaaggctctcccttcaactctaaagcctttagcttggttttaagcttttctaaatcgctgctttttttatctcctatgccaagttcagctttaatagccttaagctgttcttttaaaaaaaactctttttgctgtttctctaatctctcttgaatgcccttggcaattttattttgaatttcaattaaattaagctcttcataaatcagttctaaaacttttttaagcctatcttttacattcaaagtttcaagaactatttgatgatcattttttgaagacgaaatagtgctagccacaatatcacatagttttcccttatcttcaatattaaccatatttaattgaacttccggcattttcctatgtgcaaatatttctttagttctaagcaaaatactaccgtaaactgcctttgattgaatatcatcttttctaactggaatttgctttaaatagtcaatctcaattatgggaaacttatcattaagaacaactttaacaaatttaatcctatcaaaagttgaaacaaatatattgtaaccaccatctggaagattaattttttttattatctttccagtaactccaacagaataaatatctttactataatcaataattaatttctgttgagcattattgttatttttttctaaaaatttatcattcaaaacaaataaggcaatgatcccattgcctttcatagcataatcgattgctttcatatcagaatcagagattaaaacaatcggaataaacatccctggaaaaactggatgagaaggaaccgctattaaaggcactcttgcgggcttattagaatggggtaaaatcccagctacggctttttctttttttttatctcctgacctagcttttttagattcatccataaaacttgaaatctcctaagctaattataacaaaacaaatattttatggaaattcatttaataataattttttttattataaaataataaaatgagaattttaacagttaaaattatgaccattaatttggattatagtaaaaattacaatccgctaaaactataccattcgataataagcataataactactacttaaaattaattaatctatggtgaagttagtaaagaataatccttgaaaaatcgattaaaaatgaattctagagaagtaaatgaaaatttggaaacaaaaagaaactaatatacaggcccaagaattaactcgcattgctaagcaatataatatcaatgcctttgaggcaactttacttataaatcgagaaatcaaagaagaagattttatgtttttccttgaagacagcgtaaatttattacacaacccatttttattaaaaaatatagataaatttataaacagaattaataaagcaatcaaaaataatgaaaacatattaatctttggagataaagatgctgatggaatcacagcaacaataataatgtacgaaactcttaaagattttggacttaatgtgagttataaaataccttcaaatggagagttttatggactttcaaacgaattaatcaacacagctttagaaaaaaaaatctctttaataataactgttgataatggtatttctagcattgaagaaataaattatgcaaattcaaaaggaatagaaataataataacagaccatcatcttccaggcgaaaattttaaaactgaaaacatagttataaatcctcacctaaaagatgacaaatatccattcaaagaaatagcaggatgttgtgtaagctttaaagcttgccttgctcttagtatgtcctttacagacctttattctaaaaaccttgtatttttatttttagaaaaaacaaaaaatgaaattattcttcacgcaatagaaataaacaactacattctaaaacaatatctaagattaaataataaaaatgatcccctaattaactcaaacaaactagaaaaatttgtacaaaacaaatgtataataatctttaacaaagaagatcaaaatgaattattaaataaacactttgcaaaaagcataaacataaacacaattgatattagtgaaaattttataaaaaaatacccaaactttagaaaaaaaacattaacagacttaatccaagcaaccaaatatttcaaatacaaagaagttgagattaaagacaagctttactacatattttacaacgtaatttttgaaactaacaaaaatttgctccaaaaatgcctaaaaagacttagttttgttgcaataggaacaatagcagacaatatgcccattattaatgaaaacagaataatcctaaaagtaggacttaaagaaatcgcactaagagagagaatgtctattaattatctattaaaagatggaaacatattaacaaaaccaaatataacttcaacagatattgcatataaaattgcaccaatactaaactcaacgggaaggcttgaaaaagcagatattgcaataaattttttactaactaatgacattaatcaaatagaaaacaaatttaaagaaataaaagaaatcaacgaactgagaaaatacaaagaagaaaaagcttggaattcgcataataaaaatactatttttaaaaatgataaattcatagtttgctatgataacaatactccaaaaggaataagttctagaattgcaactagactttcttcttactatcaaaaagttgctatttttttaacaaagcaagataacattattaaaggatcaattagatcaaacaataaaatcaattcaaaaacactaatatcaataataccttcccatttagtaataaattcggggggccataaagctgcagctggatttacgctgcatgaaaatttactcgaagactttattaaagaattagaatatgcaactacaaaagttgaatatgaaactactaatgaaaacgaatcaataccaatagatgctattcttccaaaaaatttaacaaaagattctcttttcaaaacaatagaaatatttgaaccttatggctatgaatttagagagccaatattattaatgaaaaatgcttaccttcaagaactcaaaataattgacaaaaatcatagctcaaaacatataaatatgcgaattaaatcacaaaacgattattataaagctattttttttaacggaacaaaaaaaatagaagaattggatataaaagaagatcaatatttagacatcatttttacagttaatgaagatttttattatcctagagaaaaaattttgaaaatcatagacataaaaaagaatgctcaaatcaatgtatagaatacaaaaagccctacttatactgtgtattctaggaatagaaaatataaattcagaaataataaatactattcctaaagtccaatataaaaaagaggcatttcaaggagattacatatactttgcaagtaatcaaaactttaaaagtttatcacttttaagcacaaataaaaatccaatcataagctcttctccgtttaaatttacagtaggaagtaaaatttactacatagcacttatgggaattacaccaatgataaaagaaggtaaaagaaaaattcaaatagaatttgaaaataaaagctacatcaaagaaatagaaataaaaaaatttcacttcaaaaaaacaaaaattagttttaataaagaaaaagccaagcttatcacccaaaaaaaatcaacaaaacaaaaagaacaggctttggttttgtggaatattattggcaatactggagacacaacaatataccactacgatgctttagtcaaaccaataaaagatcaatacattgtaacaagcctatacggagatttaagactttacatgcaaggtgacaaaaaaatttcaaattatacaatgcacaatggaattgattatgccccatttaaaagagaaaatactccgatttttgctgctggcaaaggaaaagttgtgtttgcacaaaatagagagctaacaggcaatacccttataatacaacatttaccgggagtatttacaatttatcttcacctctcaaaattgggaataagtgaaaataaaatagttagtgctggggaatatattggacatactggaaatacaggcctttcaacaggccctcatttacactttgaagtaagaattaatggcatagcaataaacccagatttccttttaaatggcatgcttattgacaaaaataaaataataaataatattaaaagaatagaataaaaggaggtgattttttggtaacagtcactgtggacaaaaatgaaaatcttgaaaaagcattgaaacgttttaaaagaatgattgaaaaagaagcaattattcgcgaatggaaaagaagagaatactatgaaaaaccatccacaatacgtgtaaaaaaggaaaaagcttttaaaagaaaacaggcaaaaaaagtaagaaaattaaaacaaaaaactaatagatagatcgcacaagagatgttcaaatggatatctctttattttaaattaacacctctcttggctttgatccattaacaggtcctacatatcccatatcttccataatttcaataattctagctgctctgttgtaacctatcttcagtcttctttgcagataagatgctgaggcttttcttgtggttttaacaatctcaagagcttcatcaaacattggctcatcagaaggtccaagagcaaccaaatctggctcttttacactatcaataaatatttcatcatcaatataatttggagaaccaaattttttaacctcttcaacaagcctgtaaacttctctttcctttaaaaatccaccctgaattcttkgaggaaaaggatttaaagagctaatataaagcatatccccctttcctaaaagtttttcagcaccagaagatccaagaattattctcgaatccatagagctggccaccatgaaagaaatccttgaaggaaaattggcttttattacgcccgtaataacatcaacagaaggtctttgggtcgcaagaaccaaatgaatccccacagctctagccattgcagcaagtctagaaattaaattttccaaatcttttcttgcagaaagaataagatctgcaaattcatcaataattattacaagatatggcaaaatcattaaattcaaattctcatcttttatttttttattataagaagaaatatctcttaccaataaattatcaagaagcacataccttctttccatttcatcaagacaccatctaagagcctctaaggctctctttacatctgtaataactggagttaataaatgaggaatatcattaaaaagtttaagctcaactattttgggatctatcataattaatttcacttcatctggagattttgaaaaaataattgaagcaattaaagaattcacacaaacagatttacccgccccagttgcaccagctattaataaatgtggagaattaacaaggtcaaaaacaatattttcgccactaatctcctttccaagagcaaaaggaattctaaaatcacctctaaattccttgctgtctattatctctgaaattaaaataaactcacgccttttattgggaatttcaattcctacagcttctctgccaggaattggagcaataatcctaaccctaatagccgcaagccttaaggcaatattatcagaaatagaagtaatcttagaaagcttaattcccttatctggacgaacagcatacattgtaacaacagggcctttaataatatcaattaatttagcattaatattaaactcttttaatgtctcctggagaatcattgattgcttttgaatttctttatcatattcaatatcctctacatcatttttaatctctttctggtcaaaaactgaaatatcaataacgtaagaatcattttttttattcaaagctacattttcgttataaacatgagaaatagcgacctgactaattatgcccttagttcttatctcacaggctttaacctttccactaataactaacttattatcctcaagattgtctaaatatttatactcacaagactcatcaatttcatctacattttcatctaaatttaaagcattctcatttaaaatatccttatttaaagagcttgcttctttgagatctgagccttcaaaaatagttttgtctaaattaatattggaaggctttttattgtttcttaaaaaggcgctaaatgaccataaagcctgatattcttcatcattaataatattctttttttcatcaaaaacttgagaatctttaagatcatctacagaatctccataaactttaatatctttttttacatccaatgaatttgaaaagggaaaataacttaatatattttcaaacaaaattttaatcttaaactctaaaaatttaaaagtatctaaaataaaattaacatccttaaaaaagacataatttaagtaaatccacacaacaaattctaaaattaaaagagtaaaaataaaaaaattccccaatactataccaaaattaataagaaatatcttaataaaataagatttttcaacattagaattaatttttattaaaaatattaaagtaaaaaacaatattacggtataattccaattaaatataaatcgtttagtaaaaatatgttttttataggcgtaccaattaacaattggatatactattaaataaaatgacaaaaatgaaaaaacattaagaagtatttgccctagtaaattgaaaacaaaaaatacaaatacattgctcaaaggggttaatgctacaaaaagagaaaaagaaataaccgaaagcatgaaaaaaaacaaaaattgaaaatactgataaaaatctttcatattctaacaaaataacaaactataattgaaagtgcaaataaatatatagaaaaataatacagttttttgttattaagcattttaaaaaagaaatttattgagaaaataccaacaacaaaagcaactaatgctcctaagtttatttcaaaaaaatttaaaaccataaaaatatcataaaattctttatgttttaataaaatcgctccaaaaactattggaattaaagataaaaatgaaatttcaaatgcactttttctattaaatccaataaccgatgccgaaaagatcgtaattcctgaacgagagattcctggaagcgcacccaagccttgcatcagccccataaaaattcctgctaacaaaatattacctttaaaatcaacttttaaaaaattaaattctagcatcaagattaaaatccctgttataataaaattaattaaaacgaaagacaatgtaaacatactctcgtattttgaaataaaagtcccaacaactccggtaacaatggttattatcaatattagcaatattaattttaagtttgttaaatcagatttaacagtttttcttaaagaaaatctaataaaagttaaaaaaagctccaaaatccttttacgatagtaaataataatcaccaaaactgttgcaagatgtaaataaatatcaaatattattgagagctttaaatttataaaatgcctaaaaagcaataaatgtcccgaactagatattggtaaaaactctgtaatgccttgaataatgcccaaaataattgcacttaaaatatttgtcattaaatgctccaatattaatttttggggaattcgcccataattttaactattactgaatctattcccttcttttcatacaaagcatcataaaataccgaataaactaatatttttttaatataattcctagtttgactaaagggaattgcctcaataaaaagctcttttgacaaatgtccataacttttctcccactttctaacattaccaatacccccattataagacgcaagagccttataaagactgccagttgtagatattcttttttttaaataatatgttccaattattatattatcttttggaatctttaaatcatagttaaaatacttaagttctttagaaatatcatttgctgttgatggcataacctgcataaggccaacagcacccggttttgagacagcatttttttcaaagctactctctgcttttattaaagaaaatacaacactagcttcaagccctctccttttagcccaatattctatcaaagatccatacaaataaggataaagtcttttatagtcattctccattaaagcagattcatcttgatttacaagataattaatcacaagagttgcatcgtaataattttcactctttaaaagttcatcgtatacttttcgataaaaatcaagtgaaaatttatatccattcctaaaatcctcagaaataaaccctctaacataattacaaagattgaattttaaaaacccttccaaaaaaatctcataatcggattgctcatacttaatatcagacccacctgtaaaaaattcatcaatattttgatctaataagtacctactcataaatgaagaataagaccatttatcataattaacagcagaatgcaaaagactcttgtattctccgcttacgttaggtttaattaatttatgatatataagccttgcattaataaaagcaagcttagacaaaacagaattagaaataactttttgagcattagaataaagcttataaagattgccatagtcttcaagctgaattgattccaaaatatactcttctaaaatcttaataaaagtagaattttttttatcgccctcggtataaaacttgggtaaactttcggcaaaataatcccttgcgctcttagtaaaaattaaattgctaaaagcagtattaagcaaatcaagcctgttaatctcattgttaagatctaaaccttcaagatattcttttaaaagaagaagtcctaaattatttttctctctaaggtttagaatacctaaataataatttttatatttgctctttattttactaaaaaatgttaaagcatttgaaactttgccagaactaataaaagccttataaacatcacttaatacaatgttattgtcataataatcatttaaaccatttttatttaatatatttattgcaccattaaaattgccatttgccacttcatacttaaatctaacaagatttaaaaaatttgcaccaaaatacctagacttattttcaataataaaataatcataagctcttacatgtaaataatttgcaggtaagttctcaaaaagctcattaaaataaatttttgactcacttacattagaaagattaaggtaaagaactgcttttaataaaatattttcattttcctgataatcagaaaatttcatcttatcaagcttatttaaaagactaagtgccttatcgtttttcttttgccaataaagacttttaaagtaccccagtataataaatttattattttcgtattttttataaagcttctctccaatcaattcagatgcaaaatactcttttgctgagttaaaatattcaataagcttaatcccagcaaactgggatgcaatgctatctccattagctatggcctttttcatatactctacaaatttctcttcaaatcctatttttttaaataaataagcaacatatatgtaagaacttggatctatgttaaaatgcttatcaaaatttttttttgtataatcaaaattccataaccaatttaaattatttaaatcaaactcttttgaatgcgccttaataaaattattgcctgagatttctttttttgcaaagcaagaaactaaacttaaaaataaaaaaagaaaaagaaaattttgtaatacacaagaacttctattaaacatattgatctttttcatatctcttaattctatttttatcatattcaaagtaatatgaaacaaaatctctaggttttaaaatttttgaaaaaactaaaaacaaagaaaaaaatatcaaaagaaaaagagaaataagactcaaatataacataggagaatgaaccattccctcacttgaatttaatttaaaattgttttttaccatatcattctcaaaatcttctctaagatctagttcaacatcttcatctgaagtatctattaactctttatcaatatctgcaataatgtcttcaacgcttaaatcatgcaaatcttcttcttctaaagaagattcttctaatttttgaaactcaaaattattaagatttaaagacttctcgtcaatatactcaacttttttattttctaaattaagctttttagaatcaacaagactatcgtcataattatcatcaaaatcttcaaaatctgaaacatttgtctcaattttttggtcttcttcggtttttagatctaaagaattaatagtaggcatacttacatcagaaacatcttttttaacaaaatcatctttttcttcaaaatttaaatcaaattcagaacccaaattttcaacagacaaatcactgccaatgtcacttttaaaatcattcaaagggttacccctattagatccttttaaattttgattaaaatctacaaggcttaaatcaaacttcgatttatcttgaatcccatcagattcaccataaacataaagtatttcatccacaactttaaaataaacattgacactcaagctttccttttttaaattatctaagaaaaaagaaccaaccaaaaaaggatctaaaaaatcttcatattcactaacatataaattcaacttaatactggtatcacctgcaaccttgcccaatattattctcttaacagaactatcatctaaatttaaaaccggataatactcattattagataattttatcgctaaaaaccctttcaaaaatcataacctctttgctttgttaattttattgaaaccaaacttacgcactaattatagttatcattattattataactataatataatataaataatgtgatattcaacttacaaattacttttattttaagtaaataacttttattaaaagtaactatgatgatgcaaattaatgggatatttttaatttaggagcaatacgagtgttgtcactatttatagtaatctcttcattgacagtatttattttagtgtttttattttttaaaatagcattaaaacttacaataggtaaaaatatagggaaaatcaaaaaagatgatgagagaacgcgaaaattaatcgaaagagcaatttccctattaaaaacaaatccaaacgaaataggtgcccttgaaattttaaataattactactataaaaataaagaccatgaaaatggcataaaatatgcaaaaaaattatgccaattaatagaagacaacccaataaaccaagaaataaacacatttaaagcttttttaagttatggattttataatcttaaaagaaattttaacagagaagccttagaatatttaagaaaagcttttctgattaaaaaaacagatgaagatgcaaattattatcttggtgtagcattcttaaaaaacgaaatgtataaagaagctctatactatcttaaaaaagtccacaattttaataaaaataataaagatgtcctaaaacacctgggaataactttatttaatctagaaagctacagacaagctgttataatatttaacaatataaaaaaaaatatacaaggcgacattgaagctcttttggcatatgctaaatctttatcaaaaatgaatcaagatcatctagcactagagattgccaacaaaataaaacaaaaagatggaatgatttatgaggctttattgattacatctgagattcattcaaaaaataaagaattagaaaaattagaacaaaatattaaagaaataataaaagtaaaacccgacttgcctaaaaaaactttccttgaattattttataatcttggagaacttcaaatctctgttgaaaattatcaaaaagctacagaagcttttaccaaagttgaagagattgatccaaattacaaaaatattaaagaaaaattggaatttagcaaaaggttaaacgaaaacatagccctaagaatatatttgcgcagttcaaaagaaaattttgaaaaaatagcaaatgaaattattttaaaactatatttaaataaatttcaaataagagattctaaaataaatgaagtaacaacacaatttattgacataaactttcacttagctaacaatcagtgggaagaaaatttaatagtgcgttttgtaagaactgaacaagatacttttggtgaattattcttaaaagatttcatttcaaaaataaaagaaaataaaataaaaggactctgtattgctccatcaaaattctctttaaaggctaaacaaatgattgaaggaagacttattgatctagtagaaggaaaaaaactagctcaaatacttaaaaaaattaacatatccaaatacacatgaaaaacattatcttaaatatttcataggattttcagttttaccatttttaaaaatggtaaaatgcaaatgattgcccgtactatagccagtgcttcccatataacctattaccgctccccttgaaactttttttccaaccttaacggcaaaagaattcaaatgtgcatataaagtttggaatccgttgctgtgagaaatgacaatatattttccataccctcccgcattaaatcctgcagttacaacaacaccttctcttgaggctttaataggcgtattagctaaatttgcaatatctattccattgtgaaaactaataactcctgtaaacggatctggtcgatagccataccccgaagtaataacaccctgcacaggataaataaaagtctcccctaatacctcttttaaaaaatctttgggcaatcttcccccaggaataaacaacttttgccctaaaaataaaacttcattatcaagattattagaatctaaaatatcaaccttgggaacattataagcactagctatagatgagatagagtcattttttttaacaatataaacaattcctttcatattgggaactttaataactgaatttggcttaatatttcttacatctttaatttcattaaaagaaattaaagtttcactggttatttgatatctagctgcaacatgcgaaagcgtttctccaggcttaattttatgatcaaatacctttaatacaaaattttttttaaatccaggaacatttgcagaaacattggattcaggtaaataactactaatttgagctatatcttgatcactataatataaaaatgtatcaataaaataatctttgggcaaagaaagcctatttaaaaaaacatacgagccataataagaaaaaatgttaatataaaatgttaatataaaaataaagattattgcattaagcttaaaaacaagtttataatcgaatcttacactaaagatatcaaaaactttatctctcaagctcttgtaataatatttatattcataatgattaatattttgtattttaagcttatagaaaaataaagaaacttttttaaaaaaattgattttttttttaaagaagttcttaatcttaaaaactttttttcttcttttaccaatattagaaatatttgcaaaatcttttaattcaaaattaacactctttttgctattgaataaaaaattttttttacgtttttctaccctttgctttttttttggtataatcataacatgctatttcattatacaatagaaaattgcatttgaatgaaagcatcgtttaaaagttatgagaatatttaaagctcacaaatatgaactagcgtcgattttagccgcttgcttatttttaataaccttaataaagttattcttatcattttacatagtaaaaggcgaatcaatgaccccagcaatatttgaaaaaaattggattgtaaatcacaagtttgcatatggacttaggattaaaaagcaccaaaaataccttttattatggaaaaccccccaaaaaaatgaaatggtgcttattaaagatcccataacaaacaaaattgccattaaaaaaatttttgcaattccaggagaaaaatttaaacaaatagaaaaaaatacaatatgcatacatgatttaaactttaaaatagatgaaaatattttaaaaaaaaatactaaaaaaattcctgaagaccactatttagttataggagaaaacaaacagatctcattagactcaagagattacggatttataaaaattgataatatattgggaaaaataatttattacttttaaaaaatatctttgtttctttgagtttttaatcaataatacttgtaaaagtgtttgaaagactttcttttgctacattatcagatgaacttgtaatttttatttcaataaaattagaagaattggtctctaaatctttagcattaacactcaaaataccactttcatttaaagtaaaaagtacctcaattttgggaattccttttaaagctttttgaatattgccaaaggaaaacctacctatagaataatttaaagaggcttttttgtattcaccttgaagtatgtgaatctcaatttcatcttgataatcattagtagtcgtaaatagtttgcttctagaaattggcaaagcagtatttctctttattagagtaaaaaattcattatcctttatctcaagtccaagagaataaggagttacatccttaaacttaataacagaatcatttctagaaagactaaaagcatgaatacctgcgccaatagctacaacttcatcttgatttaaagcatctaaaattgtagcagaaggaaaggattcctttaaaactttttcaatcaaggggatccttgttgaaccaccagaaagtatgatttttgaaacactactaatatcaaccccagaatcagcaatacattccatagataactgaatagttttgtcaatatattcacttatcattgaattaaattcatcccttttaagattataattcaaatgcttgccatcaagaaaaagcaaagtaatgtcgacctcttccataacagataaattttttttaccctcttcaattcgctctcttaactgttctagaagaaaaatatcttctagattaaaatcaggatatttatttttaaaactatctaaaacatacttttcaatgattttattaaagtcattacctccaagtcgactttgccctttgaccgaaagaacagtataggtgtcgccttgtttttccataagagttacatcaaaagttccacccccaagatcataaataagaaaaattccatcaatctgtctttcaaaggcataagcaatagcagctgcggttggttcattaagtatggccttacaattcaaaccagcaaaatttgcagcctcaacaacacatcttctttgaatctcagaaaaataggcagggactgttattacagcattttcaatctcttcatctaaaaatttttcagcgttccttttaacactagcgagcaaatgtgctgaaatatattctgctttataaaattcaccatctactttataaaaattattagagcctatattggtcttaaaattataaaatgttttttgaggattaactaatatttgatttttagcggcacttccaacaagaacatccttatctgagaaagaaacaatagaaggggttattcgctcacccctttcatttaatattatcttagaactaacatcaaaatacgatgcaacagtatttgtggttccaagatcaatacctatccattttttcatgaacacctcccctatgtattgaaataatcaactcaacctcacctaaatctaacttaaactttttagcaatagcttcaaaagacataccttgttcatgaagtaaaataatctgattgcgaacattataactttcttttattatatttttttcaatagtaggcatagaataatccaaattacttttataaattccatcacttttcgatccaaaactagaagggctattgccaggaatagagctattattaaaccctaacaacctctggtcaagaatttcaattctctcatcaacctctttgatgattctatttaaactttcaatttttatttcaataatatttatatttctatccgtagcctgattaatttcaataattgttttatctacctcacttttaaactttctaagtatgctattagattttattttcaaattaatatacacatgaaaatatataaaaataaatataattaaaataagataaaaaacaataaacatataaaaaccctaaaacattttatctcttaatattaacatttttaccaattttaggatcttcaaatttatcaggatataaactaagcatcaccttctcttcatttttattttttttaactggaaacgaaagcaaataattatcccctactttattaactacacatacattgccaacctcagaatcagtatgacaatctcttaaaaatctaaatctagcattttgattaatttttaatcttttgtgcttttcactttcacttaaaaattgtctagctttaaaagatccaacaacagacattttaaaaacttcaaatgtatccatatacaaatccttatattaaaaattattcacctagacttaaaaggaatataggtcataactttaatataattatcatcctctataaaagtaacgttgttataatcttttgaaagctcatagaaagcattcttaatataaagcttaacgcctgaacaagctatattttcaacagaaactttaccctctatcttagtattttcaagctcattttgcaaattaattcgcttagcctctatcatttttatttccattctaagaattttactctcattaacaaattcattgtaactatcaatctttaaggatttttctgccttatctgtaatgagcacaatattcttttttaaagcaacaatatctttagttaaaacttctaatcgcttttcaatcttttcaagatgactagtaaacctagttagtaaatctttaatttcaggatcatagccaacatcaatacaggtttcacaacttctatcagagcctatagaataagccctaacctcttcttttgcacaaacattagaaccaactatttttgattttttaccaatacaaagaactctctttttagaagaaactgaagaattaacaataccccttaaaacttcaacttccccaccacaatttaaggtgacattttctaaaaacttagccctaacattaccccgtgcataaattttagaatcacccttaccatttacaccgctatgaaaaataatagacccatccgtttttaaattgcaccgacccactaatcctttcacttctattccacttttggccataatattgtatccatctaaaacattgccctgcacaagaaccattccattatttactatatctccagtagcaggtccaacatcacctttgactaaataaatattatgaacagatattacaccatctgaaacagacatatacccattgcattttgcccgaattttataaccatctctaaaagtattctcgcccaaaataaaatcaatatcctgcccactctctgattttaacactttaccaaaaacggtataaccatctacacctttgccaaaaggaataattctggccaactcctcgccttcaattacatttctaaatcctatgcttgaaacctcatactcaccaaacctattattttcatcaacaataaaatcaatataagaatccttaccctttactggctctagaccccttgcaagttcaacaggctcgccataaacaggataatccacaaattttgctactttatccttaagtattgcaatatctattactccatattttctaagaatattgaaaatatcttgtgcaaaaatttcagctccattaattccaggcgcagtaaattcaatggtaaccgacattgaattttctgatatttgaaccatcattgtaacattttcagaaggatcagattcaaaatcagcaattttttcataatatccactagcattctcaactatacctttcacaatgtctttattgaaattttcaatattgctatgcaattctaatttaaaaataacatcttgatacttaataggaattccttgtccttttggtgagataacctttagaaatacaccttttgaagatttcctgataaaaaattcaccatctgatgaaataacttctttttcacctgaatcattttttgaatcaagagacactttaggcttgctagaagaattcctataggcaactattttccattttttcttcccatatcccaatataccattactaccttttaacaaaatctcatagtctaattctttataaggtaccgagagctccaaagaagcatcatttaaggcctcttcaagagtatctgcttctatttccattaaatcaacatgactttctctttctaagtaagatcgcatcttatcacaaagttcagaaaaatttatagccctgtcatccatatttattccttcttgctcattaaagttttaatagcatctgcaacaacttttggatcattatcttcaataaatgacatttttttatttttgtcactccctctactcacgtcttccgtctcaaatttatactttttaacctcttctataaaatcaccactactactgatattttgagaattctcataaagagaatttttattttgaaaatcaagattctctttaaaatctttatcactcttcttatcatcttgaggtttattttccatattgccagacaattccgttgaaaaaagattcgacaaatatttcttaaagatatattcaattaaaagtccaataacaaaaaaaaatacaaactgcaataaagatctcactaagattgtaaaaaatgataaaccacaaaacaatcctaaaactgctgaaataaacagtgctgacacactagttaataaaatatacttcaattccctgcttataaacataatgtcttattccacaccaaaaaatcttaatataaaacctataacccctcttctttttctattatctagagaaacctcctcaagggtggcaacaatagaatcaagacaatagctagctttgctatttggatttaccaaaacaaaaggtttttgcttaaaaacagaacttctaatattttgatcctcataaatatgacccaaataatcaatatttaaatttaaaaattgccctgaaatatctataacctttttagcaactcccttggcctcgctaacattagctactctattaacaataagccttaaatttttcaaattctccatcttataagacaaaaccttaattattccataagcatcagtaatcgaagtgggttctggagtagtaacaataacaacatcgtcactagaaagcaaaaatgaaataacttgtcttgaaattccggcactagtatctattacaactatatcatattcatatatttttaataattcttttataaatttattaacatcaacatcagagagatctaaaagctccattgtaccagaagcaccggccaaaagatcaatattgtactcggtctttgttattacttctctgatgtcacgactttgagcaatcatatgatatatactatacttgggaataactccaagcaaaatattaacattagccattccaatatcagcatcaagtattaacacctttttaccaagctcagaatatttaagagcaagtccaattgcaatattacttttaccaacaccgcctttgccactactaacagcaataaatcttgttttgctgttttgaactttctcatcaactgaaaaattaaatttaccatttaatctcatcatatctcttaaactttgagcttgatcttccattataactttccttaataataagatttactttttatcttcttaataaactctgcatcatcgcttattctgtagccatttattcttctaataaaagtaagtggttctgcaacgctgatattatgaggaacaatttgcccatccgtaacataagaaactaccttcttcatttcataaatcaaacttatcaaatttccaacacaagtggtttcatccactttggtaaaaatcacagttttataattaaaaggagaaaattggtgaaatatttctttgacatctgatgtttttgtggtagagctgacagccaaatgaaattcagcatcccttccacaagcattaagaagctccttcatctcagcaagcttcatgaaatctttgggacttttaccaattgtatcaacaagtataagatcgaaatcctttgaatcagtaatttcatcttttaaatctttaaaagactcaattgctctaaccggaatacccataatatcaccataagtttgtatttgttttttagctccaatacgataattatcaatagtaataattttaatatttaaactcttagattctccattaataccataaattgctgcaagttttgcaattgtggtagtttttccaacacctgttggaccaactaaaataaaaacccttttcttaagattatcaataatagatcctgaacatttaattgtctttgcaatatataaaacaacatcctctctaaccctttcataatcatcaagatctgacaaactaaattctctcttaataaactcattaatgtctttaatataattttcagaaaaatcattttctcttaaaatgtcttcaatttttgtaattgttggatgattaatattttcttttttatgagcaagttctgttttaagagacttaacttctttaagcacatcttcaattgaagaattttcttctcttttaatactttgaagaatctttcgcttttcatcttcaacattaatttgttgattaccaatgtcatatctaacataacctgaaacttcaacccaatctttgctaaataaacctaaaatccccccatggggaacggttttataagtcataaccctagcattcttaccatattttttcttaattatttctatgacttcattataagttggacctttttctgtaaaatattgaaccatatattattcttcaacctctactgttttaagaacattaactttaatattttggggaacctctaaaacagacataacaacaagatctggaatctctctacttgttatcacttttattataggtcttgacgattcgcttgagagaacaactggataaaaaccttctgcttgaacttcgtttacaattttgaaaagttcataaataaatttagtttttaaattaggatcaattgaacttataagatcatgattggattctacacgagaatcaattatcatttgctcaaaactggggtttaaagttattacattaagctcagaatttaaatctaaatatccactagttatttgccttccaaccgattgcctacatttctcaatcaagaaaaatatatccttagtaatacttgtgaaatctgcaattgtttcaaaaattgtaactaaattgcgaattgaaacctgctcttttaaaagaccttgtaaaaccctttgaatctcgccaaccgaaaaattcttaagaacctcttcaacaatagctccgtaatcttttttaaaaacatcaagagtattttgaacatcttgacgagtcaaaatttcataagaatgtcttttaataagttctgtcatatgagtagcaataattgaaggaggatctacaacagtatatcctaatttttcagcagtttctcgcccatcatcatttacccaaagagaaggaagtccaaatgaaggatctttaacaagatctccatctattccagaatcaattccaacatttatcactaaaaatttgccaagcttaatctcgcctcgcccaacttcaactcctcttagtttaaaagaataagcattgggctcaagtcgcatattatcaactattctaatcttgggcacaactattccaaattcaaatgcaatctcacgccttatcttaacaatacgatcaagcagctcagaagtttttgtatcatcaactattggaacaagattatatccaatctcaagagctaatggatcaagcggaacaacaggagaaacatctttgtctgaataaattgacgcctgctcttcttcaagtttcatttttttatctatttcttctttttgtcttattcctgaaagagaataagccaaaaatgcaattgacaaacttaaaaacataagaattagggttggaaatcccggaagaaaagctaaaaaaagcaaaaacccggaaacaatccaataaatgcctaaatgatttgtgaattgatcaaaaatctcgccgccaaaactattttttgaaatcgacctagtaacaatcaagcctgtagacgttgaaattaaaagagatggcaattgagacacaagcccatcaccaactgtcaatgaaacataattgttaagagcttcgttaaagttaagaccttgcaaagttattcccactaacaaaccaccaagaatatttataagagttattaaaaatccaaccttaacgtttcctgatacaaatttagaagctccgtccattgcaccataaaaattgacttctgattgtaaatcgtttttttgccttgtagcctcttcttctgtcaaatttccagaactgtaggcagaatcaatcgccatttgcttgccaggaagtgcatcaagagcaaaccgagctgcaacttcagctacccttgttgctcccttggtaattacaataaattgaacagcaatgattattataaatattataaatccaataacaagtccttgaattccagaactacccacaacaaatgtcccaaatgttcttatcatttgcccatcaaaatttatacctttggttaaaattaacctagtagaagaaatattaagaacgagtccaaaaatagtcatcacaagcagtaatgtgggaaaaacagagaaatctagagatctcttagaataaagaacaattaaaataattaaaagacttattactaaattaaccgtaatcaaaacatccaaaataactgcaggaagaggcaaaataaaaccggcaacaacaaatatcaaaccgaccgaaattattaaatcagacttattattaagccccaaataccctaatatagaattttttctagcatccaacaatagaacctctaattaaactttttagtaatagaatatactctcacaagaatttttgaaacaatctcccaatattctcttggaatctcttcattaaccttaacattagcataaagagctcttgcaaggagcttattttccattaaaggaacattattttctcttgcaatttttttaattgtgagagctatttcatcttgaccttttgcaagcacctttggagctaacattgtttcgctatcccatttaatagcaactgcaaaatgttctggatttgtaattactacatctgcttgaggaatagctactcttaaattggtacttaaaataaccctcattctctcttttattctagatcgaagtaaaggatcaccttccatttcctttctttcctgctttacctcttcttttgtcattttcaaactctcaatgtactgagatctttgaaacaaataatcaaacacccctacaattgccaaaaacattactgaaaaaaaacatatcttataggcaatcactaacacaatagaaattccagattgaagtgtatactccgaaagcttagaaattttgcctatattgttttctataataaaataatatatcaagcatattataacaacttttaacaaacttttaaacaaattgaaaaaagcccctgctgaaaaaaaagaattttttgcccatctggaaaaattaaaactaattttatcccaccttggctccaaagatttaaaagtaataaaaaagcctacttgaataatattaacaaaaaaattaacagctaaagatgcgaaaaaaaacaaaacgacataccccatgatagatctaatatatgcaaaacccatagtataaacactcatacgcataacttcaggaagcttgatggcctgctctttaaaaacagctattaaatctaaagcaaaataagaaagcatgaaaaaaaacaatgcaaataacaacaaaagactaacggcagtattaatttcagtagactttaatacccggccttcttctcttgctttttgctttttctggtcagtaggtaattcggttcttccctcatcatctgcggaaaaaaaatcaaggggaatataccaacttttaatcaaaaattcatcttttatcattattttaaaactctagaaaacaattttaaaaaactagcaagagaatctagtgaaagttcaatcactctttttgaagatattgctaagcttggaaatccaatatataaaattaacaaccctaaaaatagcgaggttgaaaagctaattattaataaattaatttgaggcgatgactttgaaagtattcccaatactagataaaaaagtaaaagcaaagacaatattggaaacgaaattaataaagctttttcaaaaagaaatccaaaagacataagcaaaagcttgacaaatcctgaatttctcatattgaccaaatgttcaaccctaatgttcaaaacagaatcatgtatgccaatcacaaaaaaacgaagtaaaaaatcgcttgataagaacaaaagcaaaaacaaataagcaaaaatttgtgaaataatcatgctatcttcttctgaaaaaacatcaaaaatatttgcataagcaagcccaatttgattagaaaagaaaaatccaaccaaatgaaaaacattaaaaattatattaacaaaaaatgcctgaataagacctaaaatagcttctcctaataaaattaacgcaaaagaaagcatattgtctaaaggataaataattttaatcttttcaacaacaattacggagagaatcaaagaaaagaaaaaattaaaatatccaatttttattgttgaaaaaaatggagaaaattttaaaaacataaaaattctaaccaacacaggtaaaattgtaaaagattttaaaaccaaaaaatttaaattcaaaatttcatcccaatagtacaattagtcataaattaaacattttgcaattgactaaaaatcatataggtaaactgcataagcttattcaaaatccaaggaccaaaaatcacaataactaaaagtataacaataatctttggaataaaactcaaagtttgatcttgaattgaagtaatggcttgaaaaattgaaatcaaaagaccaactataagagctataatcaacattggggctgataaaataataatgttttcaatagaaattctaattaaataaagaatgtgtcctgcagtcatatataaccttacataaaacttttaataagaccactagtaattaaagtccaaccatctaccattacaaaaagaataagcttaaaaggcaaagatatcatcacagggggcaacattatcatacccatagccattaaaacagaagcaacaataatatctaaaactataaaaggcaaaaatattaaaattcccatcttgaaagccactttaagctcatgtaaaataaaggctgcaattaaaacatgcgttggcacttcgctaaaattttttggtcgatcataattactcatactcataaataatctaatctcttcatgacgcccatcagacatctgcttatacataaaaattctaagaggagcaattcctttgttataaaattcattaaaatttatttttgactctttaaggggcaaataagcttgttcatatatagaattaaaagttggccacatagtaaaaatggttaaaaataaagccaatcccattactatctgagtaggaggagattgttgaagagataaagcacgcctaataaaatccaaaactatagatattcgcaaaaacgaagtcattaaaactaaaaaagctggagaaagggtaataatggttaatagaatcaaaagctgcaaagaaaaagctatctctgaaccaccaatactgtcaaaatttaaaaacgggaaattaagaccattagtagtctgcaaagattttgtttgagcaaaagataaacttgttacactaaaaaataaaaaaaaattaaaacactttctcaaaataaaccctctaaaatttttttaatctatcttgtttatccttaagtgaggcctcaattttctcctcaagtttaacataatcattcccagaagaaggaatctcttcttttttgagcaacattttcttaaagattgactgaaaagaatctttcttggcagaatcattaattttgctaagcctaagttttaaatcttccagctcttcttccgacttaatctctttgagtaaagtaaaagaattactagaaactaaaaatatataaacattgtctaatatgtttatgattcttattgagtttttaacatctatctcgtaaaaaacaagctccttaattaaattagaattttgttcatatttgcttttttttgaataaaaaattaacttctttaataagaaaaagataaaaaaagcaataagtaaaaataaaactatcttaagcaaatccgaaatattgaaaatagaaactggctgagtactatcattgttaacaaaatttgccttatcctcttcaaagattggcaagctagattcattttctaaatcggtagatgctgaatttacctgctcttgtgaattagcatatgtaaaaaaattaaaaaacgataaaaaaactaaaaataaaaatttattattcatttttagttttaattatctcagtaattctaactccaaaattttcatcaattacaactacttctcccttggcaactattttaccgtttactaaaatatccacaggctcaccggcaagtttgtcaagagtaataatagtcccttcagacatgccaagtatgtcttttattttgcgctctgttcttccaagctctacagtaagctgcatagaaacatccattaaaagcccaaaattactaggatcaaccccctctggtaaagtatcaattaaatcgggaagcttaaccccctttatttccggcttttctccattatcacttttttcatctacactcataattcaacctcttaataatttaagttttaataaataaaacaactatcattcaacctcttctgtaagctcttttaataaatcaaaaccttttatatctccaattttttctgtaatttgcactgaaactttatttcccattaaacccattctgcatttaaacttttctttggtaccaactttcaaagttaaatctttatttattagagaagattcaagatttaaaacatcacctttgtcaagcgataaaatttctcttactttaagtttaacttcccctatttctgctaccaaaggcatcgctgtattttccaacttttcacgcaaagcatcaagattctcgctagtagttccaaccccaatcaaagaatgccaatatcttgttgataattttgaaacaataggctctatggtaatataaggcaaacaaaaattcataagcccttctacttttcctattttaacctcaagagttactaaaataatcatttctgtagggggaactatttgagcaaactgtggattgacctcaatatgaccaaatcttggccttaaatcaacaacttgagaccaagcctctctcatattagcaagtatacgaataataacactttccataacagactgctcaatttctgttaaatctctacttttatctttaatcgtatctccatcacccccaaaaagcctatctacaatagcaaatgctattgttggatcaacttcaaaaatagcagatcctttaagagggtccatatttattattgctaaagttgtagggttgggtattgacctaataaactcttcataggttaattgatcaactgaggctacgtgaacatgaaccatttttcttaaaagagcagaaagtgaagttgtagtatatctggcaaatgcctcgtgaaaacttgaaactgttctaacctgctcttttgaaaatttatctggccttttaaagtcataaaccttaactttttgctttttgcctgtagggctagatataacattagaaagggattcgtctaaggataaactttcagacgagttgatagactctaaaagactatctatatcatcttgagataaagctcctggattgtttgccatttaaaattcctttaaatttaaaattcttttaaatttattacatatcaaaaatatcaatttgggttaatgctatttcttttatttctccatttctaagaatgctattaattcttgccttaatttctgcttttatttgactttcattctttatttcttgaccagttctttgactaaaatattctctaataatgtcttttaagcgcactttctgtcttccaagctcattgagaatattaacattattttctgcataccccaaagcaagctttacaacaaaagtttttggaggaacatctaaggtgttacctctaatctcatctatactttcataccatataagcataggtggctttcctaagtattcattagaaaaaactggaaaatcactaggagctccactttggcttaccaccattttagacacaaaataagaaacaattatcattattgcaacagtaaatattcctattgcaagtatttgtaaaatttttattataatatcaggcaataaaccgccttttctactaacattggaatcccccatatctaaattgtcatcgtctttattaggcataataaaattcctcccattaatttcttttttaaagttaaaaagaattacttactgcttaatttccttagggaaacttaaagatgcatctgtagtaattaatatatcaattcttctattataagccctaccctcaggggtatcgtctgttgcaataggcctacttccaccaaaaccagatacttcaaaattattttcaattcttttaacatcagattgatctaaatagttcaaaatatgttccagcatattaacagatctagcagccgaaagttcccaattgcttttccaaggtccatttacatcagtatcaatattatctgtatgcccttctattttaaaattatagcctctaggacttaaaaagccaataaaagatgctattttttgaatagaatctctattctcttcaagcttaacatctgcactagcagaatcaaaaaatgcatctgctgcaagagatattacaatacctctttcttcttgcctaactacaatatttttagactgaatcttctcaataaattcaatcatggatttatttttagcagtctgagatgcttgtttattgcgcacagtagaaggcaaagacataaagctattactcaaataagataatttactaaaatctaaagttttaccgcccttgaaaaatccagcacccgtgaaagaagcagacattattcttatcacattttcttgaaaaataatatcatttaatgaaaacattgtaacaaaaaacacaagcagcaaagtaaccatgtctccataagtcaacatataatctggagatccttcatcacattttgaaggtttcttaattcgcaaagccattattcaccaccaatgctactattaagctgacttcgatctttgggggttaaaaacgtcattaatttttgctctaaaattctaggattatctccagactgaattgataaaacaccctcaattatcattgtctttactgcagcctcttcagtatcaattttttccaacttaagttgaacaggagtaaacattaaatttgccattatagttccataaagagttgtaataagagcaacagccatagaagaaccaagcgcagatttatcctctagattaccaagaagagctacaagtccaataagagtacccgtcataccaaaagctggagcaagctttgcccaagttttaaaaagatctgaaccaaccttatgcctttcttgcatttgatcaagctctaaataaagcatagttctaattacctcaggatctgcaccatcaacaacaagcctcattcctgacttaaaaaatggatcattaatttgttcaagctcatcatcaagagataaaagaccttcttttctagccttttcagaaagctctactaatatttttataatagaaaccttagcatatgaatttcttctaaagaaaaatcccaaatacgttggaattttttttacagcaacaacttctgaagaagccataagagcagaaaaagatccaacaacagtaataaaaacagagcttaaatcccaaaaaacaccaagtcctgtaggagtaaatgccatagaaattaaaatagctccaaatccaactccccacccaattatactagctaaattcataattcaacgcccccatttccttctcctaaaattttttctaaagaagcaacttctttcctatacaacttaatcctattgaccacctcttcaactttttctttaacaattaacttcttaccattcataagaagaattgtagtatcaggattagcctcaatactttcaatatgataaggatttaaataatatccatcaccattaagcttagttacaaaaatcatatactaaaaaaacaatcttagattaatttttcaatcttacaagttcttgtaataattgatcagaagtggtaatggttttggcatttgcctgaaatcctctttgggtcactatcatatctgtaaattgctctgcaagatcaacattggccatttctaaaacaccagatctaatatcaccaagtccagcaagtccagtttcgcctattctaacttgacctgaattgcttgtttctacaaaattagtatcgcctgattttgcaagtcctccgggattcataaaagaagcaagagcaatcttgccaagatctcgtcttatgccatttgaataaatgccaactataacaccattttgatcaatttcataattttccatatatcccatgccatatccatcttgaataatagcctttgtgctactagaatcagcaaactgagtaattgaatcagtgtaacttccaactgttcccaatttcaaatttacagtttgctgctcaccaacttcacctacatttgcacccaaaacattaaatgttataggaatttgaagaatatctcctttttgccctggttgaccatttaaagacgccaatgctccttcattgtcaaacccaagtgtaaaatttgaattttgctcaccatttattaatactgttgcattccataaattaggcgtatttaaatcttttacaactctaagctcaagaacactaacatttccaaaactgtcatacaatgatttattgacaacccaagttccgcgtgcaatatctgcaggattcgcaccttcttgaattaagggcaatctcttatcaagattacaagcaaaagtaacatttttcgtagactttgctccctctttatctccaatcggaataatcagatcctcaatatcagaagctgtatttataaccttttcaccttctaaatctcttgccatccaaccttgaattcgcattccatttgcaggatttacaagatgtcgatcagagtccacgtcaaaagcaccggctcttgtataaaacaaatttttaccttcttttaaaataaaaaatccgttgccactaactccaagatcagatgctttttgagtgctttgaaaagctccttgagtgtgaatagtgtcaattgaggcaacattcatgcctaatccaacttgcttgggattagtcccaccacgagcatcagtagggcgagaagctccagaaatagattgcgatatcatatcttgaaaatttactcttccctttttaaagccaattgtatttacattggcgatattgttaccaacaacatccattcttgtttgatgattctgaagcccagaaacaccagaatataaagacctcatcatataattattcctccaaacctaccgataatatatttttatatacataataattaccattaaccataacttgaggtattgcgcctgtcttaatgtttgtgacgcgaccctcaacaatctccccatcaccatgctgaaatttaattactttacctaataaatccaaatcttttcttatttctaaagaagatgaaagtttttcaaacgatctactcatattagccatttgctcaagagccgaaaattgcgccatttgcgcaataaattctttatccttcattggatttgtagggtcttgatacctaagttgagtaatgagtaactttaaaaaatcatccttgccaagattaaccttattagatatattgtcaacattaaaatctgttttttttttaactttattgctaatatttaaattaaaaacattttcaacaccgtttattttattcatttagctctaccctctaaacaattaaattaacatttttatctacatcgtaagaaaattcaacttcttcttcaattttaaaaaatttattataaccaaaatgaaaattttggtccttagagtcatctttaaaatttccagtaaaagaatttaaattctcacctgcaagaaaaagatttaagctggcattaaaaccactctcaccaagcattttatttaatgaatgcatattttggtcaaaaagcattttaacattttgattatccactacgatctttcccaataaattattatttgaatcaaggtttaaattaattcgtatactaccaagctctttgggctttaaaaccaacttaatctctcctgtattattcgattttaacacaactttagctttatccacaatattcttattaatcttaagattccactccggctttaaactgctgacaaaatcaaagcctccaacatctttagagctttttatattataattagcaaattcttcaacaaagccttttaaagaatcgtttgatatttctttaactttatacctatcaacaaaattttgaccatcaattgcatttaagctaaactttgaaaaaacaaaatcattatgatcactattattctttttaaagttttttacatcaatgttaataacattcttttcttcctttttatcattcaagcttatctgattataataatcatcaatcaaagcagttaaaaaatcaaaacccaaaaaagaacttaaatcattaaaagccaaacaaagtttttcgattttttcaaaaaatttttctttacctagaaaatcaaaattggatgataaatcttctttaatgctatttaaaccttcaaaatctaaaaatacattcattctagcaatcaaggatttcaaatcggaaacaaaatcttcattttcaagttttttaaaaaaaaaggatttatttaaaggtgatttttttaaatttttagcaataagtccattgtctttaaaaaaatttaaaaaatcaaatatcataaattttgctttagctaattttttagattcagaagacataacatttaaaaaagagctcgcatttcctttagattccattttagaaacatttaaatttaaccccttaattgtattcaagagatttaatttatttccataagctttacttaaatttaataaattactcatatacacactactccaatgaactaacagacatttttctaatcaatatagcagcttttttagaatccataagagataaccaataaggaacaattgataaacgaccttcttttttggaaagctcttcaattttccgcatataagatattgcaagctcgggatttaaatcttcaagccgcttaacagcatcttctggtggcatattcattaaatatacagctgtttgcaaaatatttgcttcctcatcattatatttatttataatgtcatctattattttttgttttaaatctaaatctttctgcttttgcttaagctcaaattcaagcttatttaaactgtcttcttttaactttagatcttctttaagcttttcaatctgctgattcttaatatcaatagcttctctttccttcacaagtctagcttcatcaagaattatattagaattatgatcaaagaccagagaagtttctcctaacaacttggttcttacaaattcggggaaatatcttttagtattatacattccaataaaatcaataaagaataatacaaagaaaaataaaataacaattaaaaataacaaaaaaaatgccctaaaaaagaacgataaaaaattattcactttcattccttagattttgacaaactttataatttacatgctcatctagtagcaagctttcctttttttctctatttttaattatagaattatttaaattttttattaatatcttaatctttttttcttgcctatatttatctacataaacatcataacatttgttataatgctttctaagctcttcaagaattttaaaattttgggtttttttataatttaaacagtctatataacctcttatgtaaagatcatcaaaaccattcaagttttttaaaatattaggaattccatctgaaaactgatttatttttgaaattttcttatttatattcattaaatctctctcgcttagctttcgaaagtaggttctaatcgtcaatattctattaagcttttgttttctaaagtttaaatcattcaagataatatttcctttatttcatcttctaaattttcaaaatcaaatgtttcgtttattccttgagaaataaaattaataatcttaggatacttagaaattgcaaaatcaacatccttattggatcctttgagataaattcctgttctaataagatcttcataatctttataaatagacaataaatttctagctttcattattaatttttgtttttctaggctcattattctatgaatagatcttgaagttgaacttaaaacatttattgaaggatatattcccctgtcaaacaaatctctgtctaaaataatatgaccatccaaaacagctttaatattatcggctacaggctctgtgaaatcatccccctcaacaagaacagtataaaacccagtaacacttcccccattaccattaaagcccgatctctcaagcaaaattggaatttcaacaaaaacagaaggcggataacctttagctaccggaggctctcctaaagaaagagacatctctcttttagcatttgcaaacctagtaatagaatcaaaaagcaaagccacatctttaccttgctccctaaagtattctgctatcatggtagcaacataagctcccttataccttgaaatgggagattcatcagaagttgaaacaactaaaacacttttttttaaacgctcttcaccaagctcatgttcaataaactcattaagctctcgacccctttccccaataaaagcaataacatttacatctgcatttgaattttttgcaatcatgccaagcaaagtagatttaccaacaccagaaccagaaaaaataccaactctttgtccttttgcaactggcaaaaacccatcaagaactttaactcccgttaatatttgatcttcaaaaatacttctattaattggattaattttttcaaaaattaactctttataactattgttcaaaaatgaccctttattatcaataggtctgccaagagaatcaataactcttcccaaaagctcatcactaagatttatttctagccctttgtttaaagaataaactttatttccaacttcaatcccgctaaatccttcataggccataaggctaacataaggaccattaaatcctaaaacctctgcgcatacctttttgccatttctttgatcaattaaacacaaatctccaatagcgcactgaggccctaaactctcaactaaaagaccttttattttttgcaccctgccaacaaaagaaacagtttcaatatcatctacttgtcttaaataattttcaaaaaaattgctcactaaaattcctttagatacttaacttaataaagaaaaatttttaaacttttcctctattttatcaagttgagaagaaatgcgcgcatcaatctctccaaaattagtttcaattatacaaccgcctttgcctatgttgggatcttctatgatctctaaattttctataatatcaaatctagaaataaaatcactctttttatgtctaacaatatctaaatcatcaagatttacacgaatggtaatctgtgttttatcttttacccttttcaaaacctcattaacattttccaaaacaatatctttttgagaatctgtaatcctcttaataactttaattgcaatttgcataacaagactcactatctggccactcgaagattcaagaatacctttcctttcagcaatcagagatgctattataacatgtaattttctcataactttgtcaaaatcttcaaaaccactttcataacctttgctatatccctcttccctacctttagctattgctatctcaagatctgtttttaatttttcttcatactctcttgctaatctttcaatctcggcattagattcagtctcaatagattctttcttataaatagcttctttttgtaaaagatctgcttcttgtttggctgcttctaatacttcattagcctttgccttagcttcttcaataagccgcttagattcaatttgaacttcctctttggcaagttcttgccttttagcaagctcttcctcaagttgtaatttttcatctcttaaaagttgcaactcttctttaagattggagatttgactttctatgtcgtaaaccttgccttccttctccttgatttccaaagattcaaaaacaggctttgctatctcaacaaactcaaactttactaaattatcaacttctgatgatttatataaaaccttaggcaaacaaaactcctttatcagacaagcacatcttcttcaccaccccttgaaataactatttctccctgttcttctaattttctaataagagaaacaattttttgctgagattcctcaacatcttttcgcctagtaggtcccaaaaattccatgtcttccttaagcattgaagccgctctttttgacatgtttttgaaaattttttcttggacaggaatatctacagattttaaagcttttgccaactcttgaccatctatttctcttaaaaccctttgtatagatctgtcatcaagtaaaactatatcctcaaacacaaacattttcttcttaatctcttctgcaagctctggatcttcttcttcaagagattcaataataaacttctccgtttttctatcagccatattaattatctcaacaacattgtcaactcctcctgctgatgtataatcttctgaagaaagagaagctagttttttctcaagaaccctctcaacctctcttacaacctcaggagaagttctatccattaacgcaattcttcttgcaacattggtttgtacttctgtgggcaaactagagagaataaaagaagccttttgaggatcaagatatgaaagaattaaagcaattgtttggggatgttcttgctgaataaagtttaaaatattcgcaggatctgctcttcttacaaattcaaagggtctagactgtaaagcagaacccaaattattaataatatcaactgctttttgagtcccaagagatttttcaagaagctctcttgcataatcaattccacccttttgaataaattcttgagccatcattaattctttaaactctaaaagaacattatctttaagctcagaagtaattgtctcaagctttgctatctcaaatgtcaaagactctatctcttcttgagaaagatacttaaacactttagaagagatttcagaacctattgaaaccaacaaaatagcggccttttgcttgcctgttaaagcagaaacatccagaatctccttttcttttttttcttccatatcaattactaccttttacgcgtttttcaaaagccatgttcttataagcttagcaacatcttctggcttttctctggctaaaagctcagcattgctttgaagctcatcgccttctctaatcccaccaacaacatcgtcaacgccaatatcgtcaccaccatccattaaggcttgttggcgccttaagtgtgcttgctttgctaattcctcttctctaagacgtcttcgtctctcaagttctctagaaatagcaaaaaatatcgtaaatactaaaattaataatgaaaatactatacttgcaataaataagaaatatttaaacctttcacttgcaaaataattttcatctatttctctaaattcattcatacgatcaaaagatatatttctaaccgttattgaatcgcctctttctggcttatattcaaaagaactttgcaaaacatcttcaatattttttatttcttctaatgccataggcttatattctctttttctcattccattttctattacgaaatctcccttctcatcgtacacaaaattccaaataccatctacgaaaataccaagagaaacacctacaatcctagcgggctctttttcgcttgtagattttttttcattcaaagcaacatttttgatctcttgagactcattatatttaccagtaatatcacttaaatcctgatattcaggaggggtattgccttcctgcccaggaggtccccagggactatatccttgaccctgatattcttttttttgagtctgagaagatataatagttgaatcgcttactttcctagtgttataagaagcttttggatcttgagattgaagctcaataggggcatactctttagactctgtagtttcttttgaagtatcaagctttacatttactcttgctatcataaatctatcaacagacaaaaccttacttaatgcagaatcgatttcacccctaagcatagcttcatacttaagctttaacttacgctctttttctgctaagtctattctatctatcccatccaaattagaaaaatcatttaaaatagttccactattatcaacaatagcaatattgtcagattcaagaccttcaatggcatactgaataagtttaacaagtccttcaactttttttctattggtaataatatcagaaccgggtcttggggtaattctaacagatgccttaacaggctcttgagactctttaaaaagagctttctcgggcataacaagattcacactaacagcatcaacatcatctaaagctacaatatgctgttcaaccgctcttgtaatagatcttctaagattaatgcttctttcaaaatcagtaatagtccacctatcaatatcaaacaaagcccatggatccatatgaacgggcacaagctcttctctgacaagaattgctctcattttttttgcaagcttttcatcatctaaataaattcttccatcagaactcaaaaaatacttaacattttccctatcaagtctttgcgatatcctatctaagagatattgatctttaatttcaaccccaaaaagagcaatgctttgacttttagtagaaaaccctattaaaaaaacaagcgcaagaatcacaaaaaaaataatcaatcctaaggctattttctgaaccgtactagcttttttgaagattccttttgctgaaacaaaaaaattagtaaaaaatttgctcaaaatcttatggctccttaacgaatattgattatatcttgataagccttcacacctctctcaacaacagcctttaaaatgcttaaattcatattcgccttagacatcgctattacaacatcatgaacatcaatgctactaggcttaagaatagcttgttctgtaaccttggaaacatttaattggcttttgttgacatcagtaatcgaatttattaaaacatccttaaaagttttaatatcattgtctttggcattacttttagaactaaaaagattcacatcaaaatgcaaaggattttttttaaccaaattaatattattttctgtaaaaaaagcatctgttctcaccaatgatctctcctttagccttgaagtatagctaacgcacttctaaacatagacttactactattgatgacagtagaatttgcctcataagcacgagaagctgaaatcatatctaccatttcttcaactaaattaacattgggaagctctacataaccctttttatctccagaacttattgaatcggggtgagctggatcatattttaactttaatggagatttatctttttcaatgctagcaaccctaactccttgaccaatgccattatcaagataatccggaataaaaggccctttccaataaggattattaacccttggtgcaaaaataatcctttgccttctataaggtccaccatcaggagttctagaagtagaaacatttgcaatgttattagaaataacatcaatccttaacctttgtgctgttaatcccgttgaagctacattaatgcttgaaaacaatcccattttacattccttaagatattaatttattttaatacaatatttatacttttaaaataatgcgcctgaacattagtcataagatgatacatcatttggttttgcacaagtgccttaacctcagaatcaatatcaacattattgccattattattcatagttgaaaaatggtcaagaactctgtgaggcttgacatctgaatactttagatttttaaacccagacaggtgcttatcactagatttaattaagtttaaatcatttttatcttcatttaaaaaagccttttcaagctctgattcaaaagaaattttgcttcttttaaaatttggagtatctatatttgctatattgtcagaaataacgctttgtcttaaactcaaaacatctaaatacctatgtgaaaaatctacagatctttcaaaatcattcaaattgaaacctccctcatttaaaattgcttttaactaaattatataataattcaaatctttttgttcgttaatttgtatttttttattaacatagtccaagtttatttcaaattttttcaacttactgccaggcacttcaaaaaaaagatctgcaagcactatttccataacaccgtgaagtcttctggcaccaagattttcactctcaagattcatattaaaagtaagctctgcaattctatctatagcttcctcactaaactttaaatctaaatcataaaccttaaacatcgcaacatattgttttattaaagaattttttgtttgttttaaaatttttttcaaatcgtctatgcttaagctcttaagttcaaccttaataggaaatcttccttgaagctcgggtattaaatcagaaggtttagctaaattaaatgctcctgctgcaataaataaaatatgagaagtatcaactattccatattttgtattaactttagaaccttcaataattggcaaaatatctctttgaacaccttctctggacacatcattgccactcctattcttagcagctattttatcgatctcatcaataaaaataattcccatattttcaactttagattttgcaatatctgaaatgttttcgtgatcgaccaatttctcaagctcttctgctaatattatttcctttgcttttttaatcttcaattctcttttcttttttctatcaaatatattacccagcaaaccgccaattcccatatcaatctcttcaaaattaccacccgtaaatatttctattgtagaaaatggcattttactagaaatttgtatttcaatagtagtatcatcaagctcacctgctctaagcttttttctaagcttctcttttaccttttcttccgcctttatttcatttggatccatattctcagaattactagatcccttaaaaagactatcaactattctctcctctgttcttactaaagcatcatctcttacagtactatacatctcttcttttaccatattaactgcaatgctcattaaatctctaaccatagattcaacatcacgaccaacataaccaacctcagtatattttgtagcctcaactttaataaaaggagctttaattaatttagaaagtcttcttgcaatctcggtcttcccaatgccagttgatccaatcataataatgtttttaggcattacctcatcttttatttcttttggaagcctagaccttatatatctattaacaagagcaattgatactaattttttagcttcgtcttgacctattatatatttatcaagttctgcaactacatctttgggaactatatagtgctcttctaatttattcattttcaatctcctcaagcacaatattagaattagtatatatacacactcttgctgctatttttaaagatctaagtgcaacctcaaaagcgcttaattttttgttctccatgtaagcaagagctgctgaatatgcataattaccaccactgccaatcgaaataacatcctcttcaggctcaacaacatcaccagtaccagaaatcaaaagaatattgttagaatcagcaacaagcatcatagcctcaagcttatgcagtattttgtcagaacgccaatcttttgcaaggtcaacagccgcccttttaatgtcaatcaagccatcaccttttgctttgattttttcttcaaatttttcaaaaagagtaattgcatcagatgttgaacctgcaaatcctgccaaaattttcccattaagcaattttcgtattttaatagcattactctttaaaacagtatgtccaaaagttacttgtccatctgctgccaccacagtcttaccatttttttttattgcaataactgtggttcctttaaagctcatattacccccctatttacatacctcttttaaaagttccccaataagaacatcagatacatttttacaattacaacactctttagaatcatcttcaatattattggaatctacatatttaatatttaataaagcataaagatccttaacggtttttatttcttgcgcaccaaaatcatgcaattttacagctccatcaccacaaaaatctaaatcataaacataaacatcaagtcctaagtcaagaccaagctcagctgtaattaaagctcctgatttcaagggtgcatatgttataaaaatagcatcagacagacctgataccaatctatttcttttggcaaaaaaataattttgaattttatcaaatggcaaagtctcagtaattattcctccaccttgttctaaaagcttggaaacatattttcgattttgcctaggataaatattgtcaatatctgttggaataacagcaaatgttctcttattctcatttattgctgctatatgagcctcaatatctgccccaattgcaaatccagaaataatctctacaccattctttgcaagatgtgaagaaaattcccttgttctctcagcaagagttttactaatttttctagaaccaacaacagcccaagataataaagaacaatctggtaaattgcccttgtagtaaatagcaaaaggagggtcataaattcttttaagcttattaggataagacttagaccctagaatagcaactttggctttggtcctttgaataactttttcttgtaattctactaattttagatcgggcaacttaaacaatcttctaaatgattttaaaaaataagactcaatgtctttctgggtcaatttaataacattattaaaatcaaaattattaaaaagttttaatttttctttgccttttaaaaatttcaaattatcaatataaagcaatttcatcataaataattacttcaaattactcatgatcctagaaacaccttctttttgctcttcagttgaagcctttttactagctttatcataaaacaatatagcattaccaagatcgcccagcgaataataatttgcacctcttaacattaaaaactcaaaatagtcctcacccatatcaccaagtttatttaaataatttttagcttcaagttgtttatcaagatcatatacgtacatattagaaatggcaaaaagagaatctttaaaatcatctctaattgaaagtgattttaaaaaagaattttcagcaagaattatgtatttttcaacttcatcttttactcttaaatttttagctaaattataagaagcaacacctatataaaaatgagataaataattattgggattgatttctaaatttttagcaaaatattcaatagcaggtccgtactgaccaagcttaaaaaattcaagaccaattaaattaaaaaatctggctttcttatcaatggaattaactatctttaaaatattcttatcttctttttcaataaattctttataaacttcaatcttagattcagatccaccacctgaaatttccaattctcttaatctaagaccaagatttgatttttctttagattcattgccacaagataaaaataaattaacaagaattattaaccacaaaattttcatctaatcatcgctactttttttatttaaatttctaagaaatgttggaacatcaatgtcatcatcaaaataattaacatttttggactttgccgcaaaagaagaatcttgttgctcataagatccagaaggagcattttgattgccagacattaaagtatcaaactctttggaacttaaagtattattttctggtgtgctagatatttctttttgctttttagatgcaaaacctgtagcaacaactgtaacgtaaatttcatcttcaagattcgaattaatagcatgaccatatattacagtagcctcatcatcaacactaaccgtgattatccccataatctcttcaagttcaagcaatgaaaaatcatctccgccagtaacattaacaagaagccccttagacccttcaatacgaacttcctcaagtaatggattactaatagcagaagttgcggcatcaacagctctgttttcgcccttgccatatcctattcccattaaagcatctccttggccttgcataatgcttttaacatcggcaaaatcaatattaacctctccatgctcaataataagccctgcaataccttgaacgcccattctaagaacatcatctgcacgcttaaaagcatctttaatggtggttcttttgtcaacaacagttaaaagcttttgatttggaataatgatcaatgtatctacagactttcttaagttatttattccctgctcagcaagtctcaacttcttaggaccttcaaacttaaaaggctttgttacaactccaactgttaaaataccaagctcttttgcaacttgcgcaataactggagctgctccggttcctgtcccgccccccataccagcagtaataaacaccatatcggcaccagaaagatgatttcgtataacatctatgtcttcctctgctgcagcttgtccaatctcaggctttcccccagcaccaagccctgctgtaacttttgctccaagggcaatttttatgggagcaatagaagtttggagagcctgaagatcggtattagccacaataaattcaacatctcttactccatattcaatcatacgattaacagcattactacctcctccgcccgcaccaatcaccttaagaattgtaggatttgtagtagaatcaaatcttcttgtatggctatcaatcatattataatctttcattaacgcttcctccatgattggtcaaaaccattctttcaaaaaccaacctttcaactttgaagatattttattttttcttttaactttactgcttaccttctttaatttattgaatttttgttgctcgtgcttataaagaacaagaccaagagctgaagaaaacttggggtctatatgctcttctccaattccattaatactcattggcaaacctattcttgcaggataattaaatacctcttctattaaattagaaatgcctgggaataaagctcctccgcctgttaaaactattccaccattaattttattataaagtccgcgcttaagtatttccgctttcatcatttcaaaaatttctctcagtcttgaattaattattacagacaactcttttctacttttttcttgagggggtcgagttccaagatttggaataattacagtttccatttgactctcaagaatagacggatgagcaatgccagctgttattttaatattttcagcaacatcctcaggaaccttccaaacttgcgcaatatcaagagtcactctattaacaccaatgggaattacacccgtataataaggagaaccatcaatataaagaataatatctgttgtccctttgcccatatcaataaataaaacccccatctcacgctcttctttagaaagagttgcataagatgaagctagacttccaagaacaacctcatcaacggcaaagccagctcgatttacgcatctgactaaattctgactagaagaactagagcccgtaataatgtgcacctctccttcaagacgaatacccatcatatctattggattttttatatggggtattccatctacaataaattcttgaggaataacatgaagaatttctctatccattggaataacaattgcctttgccgcttcgattaccctttcaacatcttcttcgttaatctctcttgtttttgaatttattgcaacaacaccgcgtgaattagtcccctcaacactacttccagacatagaaactgaaagtgatgtaatgtcacatcctgagatgagctctgcagcctcaatagaattagatattgaatcaagagccgcctcaatatttattaaaactcccttcctaactcctcttgatatactagtgcctattccaactatttctaattgatcatttaaattcacctcggcaacaacagtacaaatttttgaagttccaacatctaaacctactatcaaattcctagacactaactttctcctaacaaaatgatatcaccacttcttaaatctataacgccgggttttcctttaagcaaattaaccgcaagaaacactttatgcatcacatccattaaattcatatcaactgttatcaatattttattatatatacttttaatatacaaaattacattataatcatagaaattcaattttaaaaaattgacctctgatattaaattatacaaatatttttgatttattttaagataatcaaggcctcttacaatattaagcattctatcctctagaaaatctcctacattgttgtcattcaaaactaatccgctaattacgggcaaatcataaattaaatgcttacttttttccaaaattacaccatctgatgcaatacaataataagtaatattaccatttacgttttctaaagcaacagcaatcggtattcttttttctattttaatattaattttattgggaaacttaagatcaactttaacattctttacccttaaatcttttttaagattctcctcatatattctaacattagcattatgataatacgtattgggcttgattcctgaaatcttgattatatcctctttagaaagagaaatatcattattgatactaatatacctaatcaaaaaataaggagatgcaaaaataataattattatttcaaaaaaaattaaagacgtcaagaaatatatatacttaattaaaaattttctctcaaaaatcataacctaactcaatttacactactagaaaaatctaatcaattattacttaaattttttgaaacatttgaaataaggccagacaatgccatggtaacaataatagaagatcccccagatgaaaaaaatggtaaatttatccctgtaggaggcaaaagaccgattgcaattaaaatattcatcatgctttgaagaaaaattgcaagacttgaaataaatgcaataaaaaatttaaacctactattagaatgaatagctataaaataaccaaagtaaaaaaacaaaaaaaacaagcttatagcaaacaaaacccctaaaaatcctaattcttctccaagaactgaaaaaataaaatccgaattggcctctggtaattttccaagttttacctctcccattcccagccctttacctaaaattcctccactttttaaagcattaagagatgctattatctggtaacctttgccagaaggatcatcgtaaggattgagaaaggcaaaaattctagaaaccctataaggttcaagcatcaagaatatagcagaaactggtaaaaaagtaaccacaatagcaaaaacatagctaaatgccatattagaaacaaacaaaacaataaaaaaaagaatggcaaaataaatagctgttgaataatcgttttgcaaaattattaacacccaaaaaattgcaaaaatcaacattggctttatccagtatgaaataccattgttttttcttgggtcaaacttgctcaaataagctgaaagataaatagtaaaagatattttaaaaatctcagaaggttgaatgctaacaccttgaaagaatatccatctctttgctccagaaatacttggagataaaaaagttgccataattaaaaaaagagttataatcaatacaggaaatattgatttttttaaaaaatttaaagaaatcctttcaaaaacaagaaaaaccataaaacttaaaaaaagataattaagtcttgtgaaaaataaaaaatttggattacctgtcaattctaagcttagaaaaaaggaagaagtataaaaaactacaaggccataggctaccaatagcagcaaaacaagcaaataacatgtcctaagtgaatttatctctacaaccataataaattatctgatttttatcgtgcttaaagcaattatagcaaatattaaccctattatccaaaatctaataacaacttgcatttcagaccacccaagttcttcaaaatgatgatgaagtggagccattttaaatactctttttttagtttttttgtaaaccaaaacttgaataattacagacatagtttcaataataaaaacacccgcaagaattgaaaaaagtatttcactttttaaaatcaaagctgccattccaagaatggcccccaaagccagactacctgtatctcccatcataattttagcaggataggcattaaaccacaaaaatccaaaactacccccaagcaaggccccaagaaatattacaagctcttcagaacctttaatatttggaatatgtaaataagctgcaaaatcagccctacttgtaaggtaagctattattattaaagcccctgttataactatactcaatccaattgcaagtccatcaagcccatctgttagattgaaagaattagaagcagaaattaaaataaacatgccaaaaggaatgtaaaataaccccaaatctatttgaaaagacttaataaaaggaaaatagattacactaacatgctcaccaccaaaataatataaaatgccaacagaaaaaaaggaaaatattatttgtccataaatcttaaatcgagctttaagtccatctgaggttttctttttaatttttaaaaaatcatctataaagcccaaaaaagcaaatcccagcataacaaaaaccataatcaaaaaataaacatttaaaatgttgctccaaaatactaaagagataaaaacacaaaaaaaaataagaatgccccccatggtaggaattcctgctttttcacttaaatgtcttttagggccatcttctcttaaaatctgatcagctcttaatttttttaactttaaaataatataagggcccacaatcaaagaaagtaaaaatgcaaaaattgtagcataagccattctaaaggtaatatatttgagcaaacgcaaacctaaaaggtaaaacataaaaaccccactatcatctaaatatatttaaaattctctcaagcctgttaaaccttgagcccttaatgacaataaaaactgaaggttccaagctttttaaaaaaaaatcaataaatttatcaaactcgctaaagtaatataaacacttttcaactaaattctcagaatccctaacatctaaaaattcttcgccaattagaaaaattttatcaaaattcattgaaatagcctcttgaattaaatctttgtgagttttgtatgccaattccccaagctctttaaaagacccaagaactataaactttttgttttggatattaagatctaaaatcatattttttaaggccataaaagaacccatattgccattataagagtcgtttaaaatcaaatatccattttttgtcaaaatttctgctctacccttttgaaaagcagtttcaataaggccctcttttatttctttttctctcattcctaaaaataaagccaaattaatacaccctattgcattaaaaatattatgccgacccagcaataaaatagagtattcaaaccctttgtaaacaaaatcaaaagaaaatttcccatccaaaaaagaaaatgacttaatactaagattttcaaaatcaaaataaacgattttaacatttggatttgcgatttttgctcttttttcaagataaacacaataatcattcatttcatttacaacaaagatttcaatgtttttgccaattattttgcttttttcaaaagcaatagcttgcaactccttgaaggcttgcatatgcgcataacttatattcgtaataataacaatttctggttttaaaatttgagataaaagatccatttctccaacataactaactccaacttcaaaaacagcatattcttcattaccctctacccttaaaatactaagaggaagtccaatatcagaatttaaattaccccaagttttgtaagttttgtatttctttgaaagtatactgtaaagcatctctttagttgtagttttgccattgctacccgtaatagcaattcttttaaagcttgttttttcaattaaaaacgatgccaaagcttgaagaagttttattacattgcttgtaagcaaaaaaaccaacccttcattgtcatttaaatatttaatacactcagattcatgctctcttgagcatgcaaaacatttaacacccagatcaattaaatatttaacaaaagaaaatccatctactttatttcccttatacgcaaaataaagactatcattgatattgtcatcctttatttcgcgactatctaacgaataaaaagacactactctttcaatattttttatattccccacaaatttcacatctttagaagagattaaaatatccttaatctttatacgcactcaaacctcattctaaaatcttttactcaacaaaaatatttatatcttcattagcttttttttccaaatttaattctccaaaacaaaaactctctattctatcaatattttcaagctcatatattaccgtcagtaaccttaaattatcatcaataatattttcctgttcattgtctaagtgattaaattccctaagctttacaacatatctgaaatttaaataaatattaaaacacaatataactgttagtatcaaaactaaaatacaataaactttaaattcaatcttacttatgctgttcataatttttttacaactctaagttttgcactccttgaaggtttgttttttttaatctcatcaaaacttggcataatgggcttttttgagatcttagcatacaaatcacagctcaagcttctaaaaaaatcttttacaatacggtcctctattgaatgaaacgtaataatagctaaaattccatctttagctaaattttctacccaaaaaggcaagctccttttaagccgagcaagctcatcatttacataaattcttaacgcttgaaaagtttttgtagctggatttattttaacttttgaaaaaggataaactttgcttattatggattgcaactcttttgtggtttctatttttttaatttttctatattctacaatagccttagaaattcttctagaataatgttcattacttaaatcataaattaaagcttcaaggtcatatttactataagtgtttacaatctcagccgcactaattttgcaagaagaagaacaaagcctcatatctaaaggctcatcttcaagaaaagaaaatccttttttactacccttgtaatgaaacatagaaataccaagatcaactaaaataaaattggctttgacatttaaaggataattgacgaaaaaattatcaaaccaatcattaaaatatgtaattctctcttcaaaaatagaaagaaactgccttgctctttctaaaatttgaggatctctttcaattccaaccaaacttaaaaagtcatatttctcaagaatagcctttgcatgaacaccttctccaagagtagaatcaatgtatattaagtcactttttacgggcaaatcttctataagcttacaaattgcatcaagaagtactggaaaatgaaaagcattattattcatttaatttaaacctataaattatttttttttcatttccataaacatcgccatattttattttaagctcattcttacccttaacaaaattaagatcatttatcttaagacatcccccatcttttttaatgttcaaaatatctaacccataatttttctcttgggctaaagtatgtgtatcattaatcaaaaaaatattttgaaaatctgaacgaagaatacttttattattcaaaatagcttcaaaataataaattcctttaagagaattttcaaaagattctactttttgagtatgaaaatacaacaaaagactgtattgaccagaatctacatttaaatttatatttttggataattccaatctttcatcatcgccctttccttttaaaaaaaccctacccaatgtataaactgtctcagcaaccacattgttcctatttttgataataaacaaaggattgataatttttttagcactaggatcattaactaccaaatcaataacactcttttcatcttttaaaaaaatttttccaagcttataaagaaatcccccaaaaacctctaaatttagatttaaatcattatcaaaaataattaaaatactaccatccctatttaaactattttttgaatataaaattttataattattggaaaaaacagatacggttttttccaagggccttaaccttaggctaatattcaacttattattatccaacacaccaaaatctttaactaaagcaaacttttcatcatttctaaattccaaaaatgaatataaatctaaaatattaaagaaaaatataaaaacaattaaaatcactgagccaatcccaagtattttaaatcattattactattaaaatacaaaagtccctttccaaattcaacaaaagagcttatttcatctttaataaaaatattatcaaacaatttaaaagaatttgcagaataagtttttatattaatgattttttcactctcagaataaaaatatactctataaatattttgaaaataatcatatgacgctcttaaaatagaatttttattttcaaccttaaatattctaccacttttaatatttatcaccgcaagtgaatttttgccttcaataaacaaattatgataatcatctatttttataaaagtctcaaaactattaatggttaaattgtttaattctaaaatttttttataattattctctaaatcaattatttctaaaaaatactcagaactgccttttagtgaaaccaaatatttattatcggagcttaatttaacaaaacatgttggaaattttctctctaaaaaattttccatataaattatcttaccctgtttatatatataaatctcaccattagaaagtcccaaaaccaaaacttcattattatagtccacacttaaaattgaggacaaaaaattgagcattagtatattatttccgctagaatcataaacttctaaagttttatataaattatttaaagtaaaaattaaattatttattgcaaaaacaaaatcctttagcttgagtgtaaataaaaatttattgtttttaacagaaaaaacagaataatcttcgccggaattaaaaagcacataataatagtctgaataacttattaagttatcacttaaaagagaataacaagattccccgaaattaagacttaaaaccttatttgatacaaaaacattcttacttaaatttatatttttacaatcagatttattttcaaaattcttaaaatcataaaaattagatacattcatagtagatcttataaaaaaatcaatcaaaattataaataataaaaacaagcttagaatcaaaaaaaattttaattttttgaatttaatagtgccctcttctacattaaaactcaatataactactttctccccaccttaatttatctattttactttaattaaatctgaactaaactttgaagaccaaactccatgaaaccttgaaaatttttcagcagcttctttttgagaggctatagtagccaaagctcttccagcttcaagataaccaagagaatgcagtccaaattcatgagatccactaatctcatatttgccccttaaaataaaagctccttcttctaaaagctccaacactttaataaggtgttcaaattgaaatttataataaggactctcaagttttaaattcttagaaaaatctctaaaatcaataatatttttagaaaaaacaataaatttgagatacatatcctcaagaaaaacaagtgttttagaatcttttttgctaaaaattttagccaaatcaattaaataacctaattttttaataattaaaaacctctcttctggatttaaattaagagcctgaggcatttcaatcaactctcttggagtaatactaagaacagggctaataactaaactaaaatcagaaatcaacccagacaaaattttttttatagaataatttactttcaatctaggcctagtataaaaataatttaaagaagaaatataacttaaaacatttaaattgaaatcaataagattaaatgaaagtttagcatttgatgtaaattcgccagtctcttttatagctgctatatcatttaaagtccttaaaacaagattattaatgtacactatttttttataattttcattatcaattaaatccataaacacctgcctaaaactcataaaagggtgatttatcagctatctaatatattgattttagcaaaaaatatattaaatattttaacaagttataaatttataaaaaacaccctttaaacattaactctgcgaataaacaaaacattaaaatccttataataaaacatgtaaaatcctctaaccttattaaagattagattaaaccaaacattcaaacaacaaccaagaaaaatttttattaaaaagaacactgtttaaaaaaacattgaacttacaataatttgttttttaatctcttaacaaaagtatccgtacaaaatgaaacaaaattcaagctttgagaagaaattttaaattcaaaaacaacgtcaactccgaaagaaccaaaattaattccatctaaaaaaattgatgctgctgctataaaatattcctttgaaaaagaaatggaaagtttacttaatttagagaacacaaaagaacgattataaacagaatgtggagaaataggcgtaagtraaaatccctcaagatctgcttctaaaataggaccccctgctgagaaagaatatcctgttgagcctgttggagtagacacaattatcccatcacttttgtatgataaaaaactctcagaattaaccataagatctacataaatcattttattaagaacgcttgagcgaataataatatcgtttaaagcatatttagaaattaaatctttaccgtgttgagaaactgttacatgaagcaaaaattttttattaataaccaaagaattgttaaaaaatctatctatgacttttttaaaatcttcaatcttaatatctgctaaaaatcccacattgcccatattaattgaaataattggaatatcaatgttttcattttcaagaagcaaattaacagccaaaagaactgtgccatctcctcctaaagttatcaaaaaaagaaaattttcttttggaaaagaaaataaaggtctgccaacatctattaacactacttcaacaaaatacttggtttctaaataaactttaacatcattgcctaaaatactagctcccgactttaaagtattaatgcaaagaagaactttattcttcatattgatctttatagggaatgtcgtcaaattcgcatttatcaaaaatttttgctatatcaattaatactaagtattcactctcaagattatcagcctcgtcaagctttacaactccagatatatattttctatctaaagtttgtaaagtagcgggaggttcttgaaccctagaatcatcaaagctaataactttaagaactctatcaacaaaaatgcctaaaagcttatttttaatcttaactattaagtatcctgttaaaagcatgtcttcttctgttaccgaaatagaaggaactccaaatttaatatttaaattaattaaaggaataatactgcctctaagattataaatacctataatatattcgggaacatttggtatagcataaactccttctgatggaactttaataatttctctaatgtgctctattgacaccccatagctttcttttcctattttaaaacctgcaacttgaagctgtgatctgctgtctttagaactttcttttctaaacatattttatacctttaaatctgtttataacaatttgattaatttgctacttgccaaaacttttgcctaaaaaataaatttcaaaagaatttttccttacagctttgggtctaattttttttacaaatttaaaatatttttcaaactttttaaaaatttgcatctcgtctcctccctgaaaaactttaacaagtaaattcccttttttaagtaaaacttcaagtgataaatctattattctcatgcttaaattaaaagaattgctggtatctacaagtctatttccagtagtcttgggagccacatcactaattacaagactataaggtttaaacgtattaattttaaaaactgtatcatctaaaaagatatctccctttataaaataaaaattatcatcatatctaaggccaatatcattaatatcaacagatactagaattcctcttttaagctttttataagcatactgagaaaagctgccaggtgatgcgccaatatctaaaacattgccagaagaaaataaagaaaatttttcattaatttctatcaacttatatacagaccttgccaaatatccttctcttttggcttttttagaatattcatcatccaagcgatacacatcaatccctttaatacactttattatactttttcattataattcttattatgcaaaataaactatttttaaaaaatattgaaaaaaatattaataaaatcttttcaacaactaattttctaaatttattcaaagataacgatttaaaatttacttttaaaataaaaaaggaaacccttgattatattaaagcaccagcaattgaaattgttaataggggcggaaaacgaataagaccaatgataatgattcttttagcatatgcattgggtttaaaagaaaaaaataccaaactaatatataaattaagcttgctgcttgaacttcctcattctggaagcttgattattgatgacattgaagacaattcactaaaaagacgcggtgcatcagcaatacatttaatctatggaatagataacagtataaatgctggcaatttaatttattttttacctgcaaaattaatagaaaaatcaaatttaaaagaaaatcaaaaattattaatttatgaaaatttctttacaactctttcaaatctccacctaggacaaggaattgatattaaatttcacaatgagtcatacatcccaagtattaaagaatacatctctttagtagaattaaaaacagcttcactttttggaatggccagctttctagctgcaatactcacaaataatgaagacaaagctaaaaaaatttacagtacatttttaaagcttggtgtttatttccaaataatagacgatattaaaaacattaaaaataaaattaatggtaaagaattcggagatgatttactcgaagggaaaaaaagtttgccaataatttattttttacaagaaaaaaagtttgaaccaaaaattatttcaaaattcaatcaaataaaaaataccaaaactaccaaagcaagaaaagaaatatttaaactaacagaaatgataaactcatcaaaatcaataaaaaattcaactattgttgccttaaaatacttaaacgagtttaaaaacgaactcaatttatacccactaacaaatagatataaaaatctactaatagatactattgagcaaataaaagaaggaatataatgagaaaaataacaataatgatacttttctatggcttgataataaatgtttgccctactacaacaacatcaatattaaaacttaataaaaaagcaaacaaacatacaatagaaaaactttaccaaaaatcaatgttactaaaagattcaaaaaaatataataaagcaatagaaagtctaacaaaaataattaacatggatcaaaatcaagctgatgctcatcttttgctctcagaattagaatatttaaataaaaactggaaaaaagcaattattaaatctcaagattacttaaaaataatagactttaaagataaaaagaactttttagatatctcttgggcatactttttaataggagaagttaaaaattcaatggactatataattaaatttttccaaagcggtaaagaattgttcagagaaaacatatttatagcaattgatgccctttttaaaaaaagtatttatcattttacaaacaatgaaaatgcagcattcaatgcaatattatcttcaacgtttcaattagcactcaatgacgacacattgtttataatttttttaaataatttagaaataataaaacaaatacccttctatcattttaatagaaaaaaattagaagaattatatctacaaatcagcactctaaaaacaattcaaaacacaacgtgcagaacttaaactaagatctatcttttctcttaatcaacgaaaccaatatatttattattattgctacataaaattgaaaagaaagagaaaaataagaatttacatactcttgagtgcgaaaaaattgatattcaaaaaaaactatcaaaaaagaaattggaaaaattaataaaggatttgaaaatgcaatataaagaatgcaaatagcaagccaaccattgtttaatcctaaattataagagtaagcattaagacttaccgcaataaatgagccagcaagacttgctgtgaaaattgatacaaaaattgcaaaagatttgaaacgactgcttattttctcgcccaaaatgtcttcataactccctgaagagataaattcaaacactgctctaattcttgaataacttataacataaacagtaataaataaaaaaatgaaaaaaacagcaataaaaacaaaaatctcaaaatttccagataaatttaaagtaaaaccaggaataaaattaaaattactcttcattaaatawtcaacaaaaaaataacaaaaaatattaatacctattcctgctataaaaatatcataatttttttttactacaaaagataaaaaaaatccaaacaaaaaactaataaaaagggtaaaaatggttgacataaaaattccatatcccaaatagatgaaaaaagatgttaaaaatattgaaagatacgaaatgccttcaatagatacatttaaaaatcctattttctctgtataaagaactccaagtgctaaatacgaaaatacaatagcctgctcaaaaatactaaacatctactttttcctagctttaatcaaaaataaagagataaaaatagcaattgattgacaaagcccaataaattcatacttaaagtcataatttatattaagaaaattattaaattcaattaatattgaaaacaataagctaaaaaataatacataaacataattaaatcctgaaattacagcaacaattagactactccaaccaagtcctgaagttagccctaaaaccaaatatggtctaaaaaacactacaaacatagaacctgcaagaccatttaaaaaagcactgccaaatacagcgaaaaacttatatttaaattcatttatattgaaaaaaatgtctatcttttttttattgcttaatatttcaagctgaagaccataaatagtttttttgtgaataaaaacataaaaaagccaaactgatacaccaagcaaaaacaagtaaataagtgatgaatctaaagcaaacaaactattaatcctttttgtctgattagaaaaactacctgtttttaacatatttaaaataaatccatccaccaatctttgatttccataagatattaaaagacctgttaaggctttatttaatccgaagaaaaaagtaataaaaaaggggataagccccaaaagtcctacaaaaaaagaacttaaaagtatcaaaaatacaaaattaaaataggttaatccaaaaaaacttgaaaatatataaactaaaaatgccccaaaataaatctgaccttcattcccaagatttaatgaattactcttggcacaagtagcaatccccgtagccataattaaaaataaaataaagcgccaagatatcattttaatataagaaaattgaaaaaaatcaccgaaaaaatagctaatacttaatattgaaaaagaaaaaattaatgccataaagctatttctaaaaaagatcataaaaatagcaattcctttaatttttctttactaatcttttctctagatacgtttaacaaaacttctcccattttcattgccaaaatgttatcagagagcaaaagcaattcatctaaattggaagtaatcaaaagaactggcttttcttttgaataattacgaatagcaacagacatttcattataagctttgtgatctaaattgctcaaaggagaaaaacaaattaaaaaactttttgcaatatacatctctctgtaaagagcaaatttcttcaaagttcctccagaaaatgccaaagattttgaataaagaattctatatattttctcttcgctataaaattccattttttttttaaaaaaatctttaatctgattaatgtaagattgcctaataaaaattttattttcaaaattcataaatttggccaaaaaattatctaatatgctgctattatcggggaataaattaccaatacctaagggtaaaaatcccgctttacactcaaaaatatttattcgctcatatctaatgccatcaatttttatgcacccaacaaaaagaagctctcctaagaataatttttcccaagttttaattacagcttcttcgccaattatccctaaaacaccccttttatttaaagaaaaactaacatcatacttccaaaaatcttcaaaaaacaaattaaatttaataggatctttttcaaatttgttgcaattaatatttgcaacaaatactttgtcactagaggattcaagcttgctcaaaattgattctttgtttactgttctaaaacactttccatcttttaaaataataaactcatcgctaaattttatagcatctgtaatctcgctgtgggtaataaaaagagacgcaactcccgatttcttaagcaatacaagcaattttataaaagcttgtgcttctttttgagaaaaataagcagcactctcatcaaaaataattatttttgcattctctttaagagcagcaataataagtaaaaaataaatctctttaatatttaaatctttaattttcttatctaaatcaaaagaaattttataaaattgcataagccatctataatatttgtaggtcttagatttattcatcggcatgaaaaattcataaccaaaccaatagatactcaaatattcccatactcttaaattcattttcaaattaggaacttgagaaacaagataaataccattatttttagctttatctacattccaatttttttgcttaatgccatttactaatatttcaccctcatcaaattcaataagtccggcaataatcttggctagagtgctctttccttctccatttttaccaactactgtaaaaattttaacttccccaatttttaaattaatactatccaaaataggcttgtcaatatctggaaaatacttaactatgtttttaaactctaccattaattttgttccaaattaatttttataccatttgcactaacctcttctattttttttaaaagatcttcttttaacttttgactggttcgctctaaataaaaaacattcgaaacattaaacaaaactcctttatgttttatgccaaaaatatcagaatttccatagttaatctctgacttaagagccttatctaaaatatgtgaaacataatatttttgatttgtaattcctgaaccaataatattttctttattatccaaataatcttcgctatcaaaaagaactgcagagatattattctctctaacagaagaaagcactccttcaacagcaggccccacaataggaagtattaccaaagcccccgaatccttaatcaaagagtctgataataatttagctaaattgctatcatgccaattgcccaaaactcgataataaacttcagatctcataccagtatcaagaatgcctttcttgaaataacgataaatataatcattcataacgggataattttgacctgcaatcaaagcagcatttccaaagccagatttaataaattcctttaaaaaaagacctacataatatcctaaaatatatgcctcttctgctacattataagaaactgaataaacctgcttgttggtatttttaaccaaagaatcaaaaatgagaaacttagtataaggataattacttgaaacactgtcaacaatatcttgcatagcattatttgtagttattaaaaaatcatatttttttgaagttaatagtttttcaagcatttctatccactcgctttgattaaatccagcttctaaaactttaatttcaagattttcatgattttttttaaattcaaacaaagaatcatacatttctttataagatggagatcctgaaataaccccgggaataaataaagcaatattggttttgttagaaatatcaacctttcgcttcttgaaaaaaattaaataaacaaataaatataaatgaaatatcgtaaataaaatccaaaaccctttaaaaaacacctttttactcataaaaataaaacatccttttattaattattattaaattcactttaatgccataaaagttaaataaaaaatcaataacaagctataaaaaataaaaccgccaaaactaattaaaaaattaattatccgatcaactgaagagcgcatttttcccccttacgataaaattttggcaaaaaattctcaacccaaatttaataaaatattaagcaaattatgaatgtgaattttaaatttcgttgaataatataataaaacttgaaaatttttcattttttttaaaatggctgatattaatagtttcaaacagctgataaaaacaaatatgttaatttcttcttcaatttgaattttcaaagaatataccatgccatctaacaaatagctttaacataaagctaaatatataaaaatcaaaactctctagggcgcaataaatacaattcattaacatttaaattactagtaatatcatcatttgagcgtcttaaatacatctttagagaatggattgttttaaaaaacttattttttaaaagatttttattagctttgtaatcttttaaaaattttgaaatgggcccgttaacagttgttgaattgtcaaaaaaagtagaaaaatatttcaaaacatcatctacaaaataaaacctattagccaaatcaacaaaattattaaaaagcactccgattctaccctttaaataattaacatttttaatcatatcaaccctgttaccaaatttataatttttatcttccaggctccattttgaatatatagaattaaatttaaaatctttcattaaataattatacataaagttgaatctaaaactatcctcaatatattttaaaacaaaaaaatataaaaaccttttatttaaagacataaaattatctttagccatccttataaaattttgattaacaccctttaaagtgccttcattaactttgtgtaaaaaagaatttccattaaaaagcaaaagactggtattgggaaaaattaaatattcggttttattaatatgtctgatgctacccttgtaaacattaataaaacaattattaaaataatcgctattgacataaaattttgaagtattttcggctttaaacaggttattatctattataacagaaaatgaagaccctttaacaatgctatgaattatagcatcaacacttcctctaaataaatatatttttgcgtcttgcaaatctttaagagaagaataaaacacaaaactatttgtattggaataaaaaattaaatctacagaaataccatttatttcatataaatttattttaagctttgaattttctccaacctcaataaaatcatattcaaaaatttcgtcatctaaatctaacttaacgggaaatgtatttctaacaacactaactctaccttctatttcttttacaactgccacttgagaaaataaagttctacttgaaagcaatattaaaaggataaaatgatatattctaaaaatatagttctcctaatctttgaaaaactcataaatttaattataccttgttttacataaatttattacactttgaacaatgatgaaaaagaagtataatttaatttaagaattaaaaatattaagtttttattgacatactataattgctatactaataaaaatagtaaaagtaagaactttaatatttataggttcttactttaaagattaatagaagccaagttattagaagggtgtatttatgaatataaagaataaattaatatcgctgctaattgtagtagcaatctcttttatcgcatgcaaaacgcctccagaatcaagagagagtaaaaatgctaaaattgcacaaccagataataaaaattttcaattaagagatataaaagacattaaaaatgaactaataagagaacggggacatcttttttattccaaagagtttaatgaagctgaaagattagaagaagcaatgaaacaaagtttttccaaaaaaaaagcaatagaaggaaatgaaattgctctaaaagtacttgaaagatacaaaacaataataagagaaacgagggaaaaaaaagaaaaaacaaattaccttaaagaaaatattgaaaagtatctaaacgatgcagaagcaaatgaagcatacatatggatcccgctggaaatcgacgaagtaaataatttatattttgaagcaacaagaaaatataaaaattacgatcttgataatgcccttgacatgtatagcaaggcctttaacagagcacaacaagcagcaaaaaatgccaaagaagctaaagctttaaaagaaactgatgagagaatgtacaaacaattaaaagcacttgaagcggcttccaacttaccaatttatagcaataataagcttataaagccatctccatggaatggtagagcattcattaaagaaagaaacagtcacttaaaccttttaaatactaataaagacacttatcttcttggagaagcagaaatttcaattccaatagtactcgcatacgaagaaaaagtggaaatagcaaaaaactccaaacctcaagaacaattcaaaacgctagaacttattgaaagatctagaacattgtgggaaaaaggggttgaggctaaaaatgtaaaaaactttagacttgccaatgaattatttttagaatctgcaagataccttgaagcttatcaaagcaatgcaagcagcgagctttacgtaataaaaataggcaataccctatggggcatttccaaaaaattatacaacgatccttacttatggccaaaaatttggtttgccaacagacaaaaaatacaaaatccggatctaattcattctaactggaagataataattcctgccaaataagcaaaaacaatcataaagcaaggctttaaaaagccttgctttcttattttatatctaataaaattaaataataaaaacattctaaaagaggcagaaatgaaaaagctaatattactaaacttaatatttatttcctgctatacgattaacttagaaaaattaacaaaagaaactccttatggagtttatcttagagaagctcaaaaagctgtcaatgtcaatgattataactcggctttaaaagcatacgaaaaaatgattcaaaatttcgctcacaattcaaatatagttgctactggtaaatatgaaattgcattcatatactatacaacaaacaaaacagaaaaagcaaaaaaaatctttgaagagttaataggaaataatatggaaatgcctaaatggattaagcctttagctaaaaaaatattaaataaaatagaaaataataaaaaataataatttaagaaataaaaatttttactgaaatattattccataaattgtaatatctttttcctttgcagaattgataacatctttataaacaatagaccctcttggatactcatgaggaggtgcatctcctataacaataataaaccttctttctgcccgccaatcaaattgggtcacagcagcatcaatcccctcaaaaacagcttctggataatccccaccgccaccaacattaacatacttaagaatattatttaaataaggaatagtattaaaatcaaaagctttggttaaaaaatcttcaagatagtctttataaaaaacaagacctattctgtaggatttaaacttttgaagttgaggttctattattgaaaacaaatgctcttttagaatctcaatattgcttttcatactatcagtaacatcaacaacaagcactaaatctaaatcataaactgaatcttctgagttttttaaaattttgtttattttatcaacaatatcaatgccattattagcaataacaacctcatctgaaaattttgtaaaagtatcttttaattcattaaattcaatttttccctgattttgatcatccttgaaaagcaattcataagcattgtcttgatatctgcccaaataatcattatattttttctcaaaagatcttatagaaaaccaaaagggctcttttttactttttaatacttctaagtcaatatcaccacttcttgttgaaaaatttggaaatccatattttaatttttttggaatcaatatatgaaaagcttctccaaactttttattaggaacaggggtggaagatgtcaatgataaaagttctttattcttaataactcttccatttaaaatccgaatttcatctccattaaccttattataacttaatgtacgaaatgaataagtagccacatcttttttcttatcaggaatttcaaaagactctgtcaatattactgatttgattgcaggtttttttctaataaaaagatgaaatccctcttcatgagcctcaacataaacatcatcaatacctattttcaaagaactatcttcaaatccaaacaaataaaaactaataaaaagaaataaaaaaattttcttcataaggaaaccaccctcataaataactcaaaaacaatgaataagatctataattaaagtttttcggataaattttcataaaataaaacattagatttagaaaaactattcttaaaaatattcctgagatttaaactagcaagatcttttttaacactttttaccatatcttcatccctatttaatatatcaaaaatcttggctgattcgcttaaattgctaactccagaattaaaaagtttagtatctcttatagatgaaaaagaagccatcacttctacaaccccaagattattataagtctcaatttcttttaataaaagagttttatgataatcattttctttggggttaaaattcaaaacattagccttctctagttctaaattttgcataacccttaaataatagctcctagaagctaaaaaatcgcctattttataaagagttagggcaatagtatttaaaacttcgttactacttgaaaaccccgccatgctctctactttaaataaatatttcaatgcatcatcataattattttctctataactaagtagtccaactttatagtaaacatctggataatcaacgccctcatttattgccaatttgtaagaagatatcgcagacttaaagtcatttaaagatctaagaatatcgccttgcttttcataaattgaagaaatctccttagatccttttataagattgtgttttttataaaaagaataatcactcaaggctaaaccaataatattactagccctaagagaatctcgagttttttcataaatgtctgctaaaattttataagccaatatcttgtccccagcatcttcaattgaatttttatgcctaaaactatttaatgctttaagcaaataaacttcggccttcttaaaatctcctatgtaatacgaatatcttccactttcaaaaagtgccttgtcgtaattgggatttttatttaatatttttctgagaatgtattcaatctctgaattcatattaacattattgtcaagcttaaaaatagttctgccatcatttcttttaaaatcagaaaattccttattcaataaatttgtttgtccattaagataatttaaatttatagcaagattatttgctctttgattataagtcacaaaagaaatatacttatctacaagctttttagcatattttgtgtaaacaacttcatcaatatctagaatttcatttgacttaataaaattattgacattatcagactcggtatctaaattagcttcaatataagcattgaaaagcttaaataaaatttcctttttttgtccatatttagaaagcacaaccgtatagctattaatactatctttatagtagttggaatttgtcttagcccatttaaaataattatctccctttaatactaaagcatcataatcgtaaagatcataagatataacctcatcaagtattgaattagcctcagagtgctctccaagaccaattttcatggaagcatacgaaatatatccttccttattaaacttttttcgtcttctgtttgtagaatttttagaaaaaggctcaatagtaaacaattcctcatacttctcttcagcactatcaaaatctctaacgtcttcaaacgccttagcataattaataaaccatttatcatcaggcctaatatagtaagcatctctaaagatagatttggcaagatctcttttatttgcatatatagattctatgccctctttatacttgctctcagaggcaacataaaaaaatattacatctactataaggtacaaagaaactaaaactaaaacaacaaaaaaagaggctatttttatcaaaggtagcaaagcccttgaaaccctgtagctcaatttttgctgaagcttgctaaattcttccgccttgaaataaattacaggcaatttaatagatcgcccaacaatatctcctacaaatttagcaataaatttcaacctttttttatttttttcaacaagatcaattagcgcttcaagcttaaaccttgaaacattttccttagttaaagcctcagcaattgcaattcttaaatttctaggataggaatttaaatgctttaaaaataatggataattaaccttaaattcaaaacgtttaaaatttgcattttgatcatactctaaaaatttaaaatcatctataacgttttcaaaatcatcctcatcggcacttaaatttaaactgtctccaacaaacatctctgattgttcatctgtttggtttttgccatttaccgcatcatcaatattaaattcattagactgtaaaaaattactatcccctaaaacagaagaatcattattggcttcaaaaaaattattattgccttgattgttaatcaactcctcagaacttaattctggggaattgattaaattgtcaaaatcaagcttagaagcaatttctaaatcaatagaattatcatcaagaactttgtcaatattattttcaaaagaatcgctagaagaaacgtcaaaatcattatttaaagttgaaagctctgaatccacatcaacccttaagttagaaccacttaaaggcaaattgtcattaaaaatgtcagaataggataatttatcctcattctcaagagcatcaagcataaaatttaaatcaagttcatcatcagtttcatctaaagcaagatcttcgcctatccaaggaacaatactctctccaggctcgggaagcttaacatccatacttaagccaaaagattctttagataatctttcattagaaagattatctaatatttctcttttaaactgtattatcttatctacatcaggcatattgtaatcaagttcctagcttataaaaagctttttttataaaattcatgaccttttgcatgaagaacattaaagcgattttctaaatcttcagcaatttttaaacccaaaacttcctttgtaatctctgtctgagaatctttcaaggtgtttaaaatttcatccctatactcagcaatacttataactttgtcagcattatatataagtgaatctcttttaaaaacatcgtgagacatatctccatcctcagaaacttctaaaacatttccattgactccaatcatcaaataataatcaaaaattttaaaataattgccaatttctaaaattattttttttgtttcaggtcttccttttctatacctagtagcagtaggaaaaataagtataatgtacccactatttttcttttcataaatatacttcatagaattagtattaaaaacacgcctttgcctagcatgttctaaaccaaccccaacaaatgcgtgcggtggatacactaatattgcattgtatcccaaagaaagggtcttaacaaataaattatctctgaaaagcttaactccagctattggaataatatgatctgcaatatcatgataacccattttgtaaagtaaaaattggaaacaaggaaaatcaaaattactataatgctccattaatataattgaagacttgccagatttagtcttttggtaaagttctaaaatattttgtatgccaacaatggtagatccactctcaagaagtctctctatcattctatctgccaatcttctactcttagaatctgcatttcgataagacttatccaaataattaacattttcaacagacttaaattgacttacaaagtcgctttccatgtctttaaaatatttatcaaaactttcattttgtacaaacataaaaccagcaccctttaaagcattctatgttgccacctaaccattagttatattattttatttactaaagacaaaaagctctataagactaacaataaataactaatattaaacaagcatacatttttgaaaacatttcacaccattataccttatttactatacaaattaaagtaaaattttggcttgcaacaatagacaaataatactaaaaactatttaaaattattagactttttttattataagaattaaagtaaaatttaaatacaagacaaatcaaagtaagacaaatcaaagtactggaggcatacatatttaaaattaaaacaaaataaatattctttattaaaatttattaaaaaagattaataaagaatgagaacaaaaaatatataaaatattgaaaaaggaaaatcccatgaaatatataaaaatagccttaatgctaataattttttctttaatagcatgtattagtaatgctaaaaaagaaaaaatagttttcagagtatcaaacttaagcgagccatcatcacttgatcctcaactctcaacagacctttacggtagcaacattattacaaacctattcttaggcctagcggtaaaagattctcaaactggaaaatataaaccaggacttgcaaaaagttggaatatttctgaagatggaattatttacacatttaacctaagagaagatatagtttggagcgatggagttgccattactgccgaggagataaaaaaatcatacctaagaattttaaataaaaaaacagctgcaatgtatgctaatttaataaaatctacaataaaaaatgcacaagaatatttcgatgagacagtgcctgaatctgagcttggcataaaggctattgacagcaaaaccttagagataacattaacatctccaaagccttattttcctgatatgctaacacactcagcatacataccagttccaatgcatattgttgaaaaatatggagaaaattggacaaatcctgaaaatatagttgttagtggcgcatacaaacttaaagaaagatcaattaacgataaaatcgtaatagaaaaaaatgaaaaatactataatgcaaaaaatgtagaaattgatgaagtaatattttacccaacagaaggtagcgtggcttacaatatgtacataaacggtgaactcgattttctacaaggagcagaaaagaataatttagaagaaattaaaataagagatgattattattctgggttaaaaaacggaatggcatacatagcattcaatacaacaataaaaccactagacaatttaaaagttagacaagccatctcccttgccattgacagagaaactttaactaaagtagttttaaagggaagttcagatccaacaagaaatctaactccaaaatttgatgattattcttatggaaaaaatttaatactatttgatcctgagaatgcaaaaaaacttttagctgaagctggatatccggatgggaaaggattccccacattaaaatataaaatatcggagggaagaccaacaacagcagaatttttgcaagaacaatttaaaaaaatactaaacattaacttagaaatcgagaatgaagaatggacaacattcctaggaagcagaagaactggaaattaccaaatgtcaagcgtggggtggataggagattattttgatcccttaacattcttagacagcttatttacaacagaaaatcattttttaggagcgtacaaatattcaaacaaagagtatgatgctttaataaaaaaatctaattttgaacttgatccaataaaaagacaagacattttaagacaagctgaagagataatagcagaaaaagactttcctatggcacctttatatatacccaaatctcattatcttttcagaaatgataaatggacagggtgggtaccaaatatcgcagaaagctatttatatgaagatattaaaactaaaaaataataaaattaagtaaaataagtaattttaaaattaagatttaaaattaatatctacggaaagaaaattatgaaattaaagttaaattttaaaacaaactttgaaatggaggtataaaaaattatgaaattacaaaggtcattatttttaataatattttttctaacttttctttgttgtaataacaaggaaagaaaagaaggagtatcatttaaaataagcttgggagcagagccaagcagtcttgaccctcaattagcagaggataatgtcgcatcaaaaatgattgacacaatgtttagagggattgttacaggagatcctaatacagggggaaataaaccgggacttgcaaaagggtgggatatttcttctgatggaacagtttacacatttaacctaagagaaaaaatcacttggagtgacggagttgcaatcactgcagaaggaattagaaaatcttatcttagaattttaaataaagaaactggctcaaagtacgttgaaatggttaaatcggtaattaaaaatggtcaaaaatattttgatggacaagtgactgactctgaacttggaattagagcgattgatgaaaaaacattagaaataacactggaatcaccaaaaccttattttattgatatgttagtacaccaatcatttattccagtaccagttcatgttaccgaaaagtatggacaaaactggacaagccccgaaaacatggtgacaagtggtccttttaaattaaaagaaagaattcctaacgaaaaatatgtctttgaaaaaaataacaaatactacgactcaaatgaagtagaattagaagagattacattttacacaacaaatgacagctcaacagcgtataaaatgtatgaaaatgaagagctagatgcaatttttggttccatacccccagatctaatcaaaaatctaaaattaagaagcgactattactcatcagctgttaatgccatatacttttacgcgttcaatacacacatcaaaccacttgacaacgttaaaattagaaaagccttaactcttgctattgacagagaaacgcttacatataaagttcttgacaacgggactacccctacaagaagagcaactcccaactttagttcatattcttatgcaaaaagtttagaattatttaatcctgaaattgcaaaaacccttctagctgaagctggatatcctaatggcaatggatttccaattttaaaattaaaatacaatacaaacgaagcaaataaaaaaatttgtgaatttattcaaaaccaatggaaaaaaaatttaaatattgatgtggaacttgaaaacgaagaatggacaacatacttaaacactaaggcaaatggaaattatgaaatagcaagagcaggatggataggcgattatgctgatcctttgacatttttaagcatattcacacaaggatacacacaattctcatctcataattactcaaacccagaatacaacgaacttataaagaaatccgaccttgagcttgatccaataaaaagacaagacattttaagacaagcagaagagataattattgaaaaagattttccaatagcaccaatatacatatatgggaacagttaccttttcagaaatgacaaatggacagggtggaacaccaatattttagaaagatttgatttatctcagctaaaattaaaaaataaataatataataaactttataatattaaatttaattaaataaaaatcgtctattatttattccttatggacggtttttattgactttattataaaaaaaagatagtttaaaacttataaataattttaatttgggggaaaggttaatatgagctttaataaaactaaaaaaatcggtaaaaaaattaaaatagtaacactacttatgcttgctgtgtctttaattgcatgcaataataattcagaaaaagaaaaattagcatttaaagtatacatagggggagcgccctcatcgcttgaccctcatttggtagatgagacaataggagcaagaattttagaacaaatattctcagggcttttgacattaaataccaaaacaggaaagctaaagcccggacttgctaaaaattgggaagcctcaaaagataaaaaaacatatcaattttatctaagggacaaccttttttggagcgatggagttgaaattaccgctgaagggataagaaaatcttttttaagaattttaaataaagaaacaggatctacaaatgttgacatgctcaaatcaataataaaaaatggacaagagtattttgacgggaaagtatccgattctgaacttggaatcaaggcaattgatagtaaaacgctggaaataacacttacggccccaaagccatattttcttgaactgcttctacattacgcattcatgccagtacctattcatgtgattgaaaaatataagggaaattggacaagccctgaaaacatggttactagcggtccttttaaattaaaaaaaagattacctaatgaaaaaattatctttgaaaaaaacgaacgttattataatgcaaaagaagtagaacttgatgagcttgtctacattacgtctgacaatgatcttactgtgtacaatatgtacaaaaacaacgaaattgatgctatttttaacagcatcccgccggacattgtaaatgaaataaaactacaaaaagactattaccaacacaaaagtaatgcaatttatttatattcatttaatacaaaaataaaaccccttgatgatgctagagttagagaagctttaaccttagctattgacagagaaactttaacttacaaagtgctaaatgatggcacagttcctacaagagaaataactcctgatcttaaaaattacaattacggtaaaaaattggctttatttgatcctgaaaaatctaaaaagcttttggcagatgcagggtatcctaatgggaaaggattcccaatgctaacactaaaatataatacaaacgaaactcataaaaaaattgctgcatttattcaaaaccaatggaaaaaaattctaaatatcaatcttatgcttaccaacgaaaattggcctgttcttaccaacagcagaaatactggcaattttgaaataataagagttggacgcattggggaatatttagatccacacacatactttactatattcacaagagaaaattcacaacttgcatcatacggatattcaaacctagaatttgacaaactcatcagagaatcagatcttgaaaaagatcctataaaaagaaaacaattactcagaaaagcagaatcaataataattgaaaaagattttcctgctgcaccaatatacatatattctgggcattatctttttagaaacgataaatggactggatggaatcctaatgtatcagaggtttattatctttctgaattaaaaccaattaaaaatgcaaaacataattaattttaaaaggattttaatataaattaaaaacaatatttaagtctaaaagcaaagctgactaagcttaagacagtagctttatttaaaacaaaaatacataaataatgtgtaagattctatgataattttacttagaatcttacacaaaaaaattcttctcaaatcaagagaataaaattttaaataaaaaattaaaaacaaaaaatacattttattgaaaattaaattactcattataatacaaaaaacctcctattctatcaaaaattatcaactatagcttgaaaaacaataaagactatatgatataattgactaatacgtaagttatcaatatctatttacaaaggagcaaaaatgttaaagtttactttaaagaaaatattaggaataataccaactttactggtaataatttttttatgcttttttgtaatgagaatggctcctggaagtccatttgattctgaaaaacctattgatcctcaagtaaaagcaagattgatggaaaaatatcaccttgacaagcctttttatattcaagctttttattacattacaaacgctctcaggggagatctgggaccttctttgaaaaagaaagaccttacagttagtcaatacataaaattaggatttccaaaatcacttacactaggagtaatatcccttattatatcactatcaataggaataccaataggtatattagctgccatttataaaaatacttatgtggattatataataacatcaatagcaatattggggatttcaataccattattcgtaatagggccaattttacaatatttttttgcaattaaatggggtttgctttatacctctggatggattacagaaagaggaggattttcaaatttaattctacccataataactcttagcatgcccaacgtagctattttcgcaagaataatcagaggatcaatgctagaaataatacaaagcgactttataagaactgcgcgtgcaaaagggctaagcttcaaaaagatagttataaagcatatgttaagaggagcaatgttgcctgtagtaagctatataggtccagcatttgctgctataatatctggaagcgtggttattgaaaaaatatttagaattgctggaatgggaatgtttataacagaatccgcactaaacagagattacccagtattaatgggcggattgttagtatattcaataatactgcttatttctatattaatatcagatattatatataaaatattagatccaagagtataaggggaaatcaaaatgaatagccttgaaaaacaaaatgaagaaaacaattctaaactagaaagaagagcttggtcaagatttaaagaaaataaactcgcatttggcagtctttttgtaattggattttatatctcaattgccattttgcaaccaatattgccaatatataaataccatactcaaatagtagagcattctgatttgccaccatctttccaggctgctggagaactctggtataataaagaaaaaaaatttattgaaaaattagcaaaaaaagaaaaaagagaaataaatgaagaagaactaaaaaaactcgaagacataaaaagaaaaatagaaaatgaagttcaaataatagataaaaaggaagtaaaaatacataaaagagtatatttgcttggcacagacaatcttggaagagatctgcttgcaagattaatacaaggtagtcaaatttctctttctgtaggatttattggagcttttttgtctatgataataggaactatcctgggatccatagcaggattttttgggggattgcccgacaaaataataactaaaacaatagaaattctttatgcattgccctatttacttattgtaataatattaatggcaataatggaaagaagtataatcggcttattcatagcacttgcatttgtatcatggttaacagtagctcgagttgtacgaggccaagtacaatcactatcaagttcggaatttatacaagcagccaaaacccttggtgcaacaaatcaaagaataatcttaaaacacttgatccctaatagcattggaatgatagttatattcacaacaataagggttccaagctttattatggctgaagcatttttatcctttttaggacttggaatttcagctccaatgacaagctggggagaattagtgcaaaatggaattgctacatttgttgaatatccatggaaagtttttattccagctatagttatgacaatatttctattatttatgaactttttaggtgatgggctaagggatgcttttgatccaaaagatagcatctaaggagaaattgaatggaaaaagaaaatatattggaaataaaaaatttaacaattgaatttagattaaaacatacaacaattcatcccgtaagcaatgttaacctatctgtaaaaagaggagaaattagagctattgttggagaatctggaagcggaaaatccgtaacaagtatggctattttaaaattattaccagaacttacaacagtatataaaagtggagaaatactatttgaaaatcaagatctgctaaaacttagcgaaaaagaacttttaaaaatcagagggaataaaatatcaatgatatttcaagacccaatgacttcattaaacccatttttaagaatatcaactcaacttgaagaaacaataatcttacaccaaggattagggaaaaaagaagccaaagaaaaagcaatagaaatgttaaaaactgttggtgttgtaaacgcagaagaaagaataaaacatttcccacatcaattttcaggaggaatgagacaaagagttatgattgccatggctcttagctgtcatccatccttattaatagcagatgaaccaacaacagcccttgatgttacaatccaagagcaaatattattattaatcaaaaacctatctaaaaaattcaatacttctaccatatttataactcatgatcttgcggttgttgctgaaatttgtgatacagtatctgtaatgtatcaaggaaaaattgtagaagaaggaacagtagaggaaatatttaacaatcctaagcatccttacaccattgggcttttaaaatcaattcttacgctagaacacgatccaaataaaaagctttattcaacaaaagaaaaccctatgaagatcacaaaaaccagcaccgaggagttttaaatgagtagtaaaaaagaaataattcttaaagtagaaaacttaatgcaaacattcacaacaggagaagattttttattttggaaaaacaaacaaaaagtaaatgcggtaaacaatgttagctttgaagttgaaaaaaataaaactttaggactcgtaggagaatctggttgcggcaaatctactactcttcgctcaataatgcaactttacacgccaacttctggaaatatttactttaacggaaaaaacataactaaactttcaaaaaaagagctcttaaaaacaaaaaaagatatgcaaatggtattccaagatccccatacttcgcttgacccaagaatgacaataaaagaaataatagcagaaccactagaaatatacaatgaaaacaaaattcttccaaaaacaaaacaagaaatagaacaaagggtaaacgaactaacagatattgtcggactacataaaagtatgttaaccagatatcctcatgaattttcaggaggacaaagacaaagaataggaattgctagagcactagctttaaatcctaagcttttgcttttagacgaagccgtttctgcacttgatgtatcaatcagagctcaaattttaaatcttctaaaagctctgcaaaaagaattcaatttgtcttatttatttatttctcacgatcttgccgtagtaaaatatatgagtgataaaattgctgtaatgtaccttggagttatcctggaacttgcacctagagaaacgctattttcaaatccaattcatccatatactaaaatgctaatagcatcaattcctgaaatcaaccctgaaaaaagaaaaaataaaaatataaaactagacgagcaaactctagcaaacattagaaaaattcatttatcaacccaagtacatccaaagctcgaagaagtagaaaaagatcactttgtatctaaatacctttttgatgagatgaacagataaataattaaaagcttacttatgatcaaaataggaaacttcgaaatctattttattatcaattccctcaacaaaatataaattaattctattaacattatttttatctattactttgttaccagaatcaataaaataataataaattctatccttgggtaaatttttaagcttaatagtataaattcccttattgtcctctttctcaataagcctatttaaaaaaggattaaaattgttaaaactaccagctattgtaactatttgtccaggacgacctatgtaaaaaatttcaatttcattgttatcatatgattgtattggatttctcaaagaaatatagctggacttctctttagcgatctcaattttagaaaatgggattaaatcctcattataaactacatttttattatactcgtcattagtccaaacaccgtctacaataagcctatattttatactgcttgtgccatgaggaatattaactttaacaaaaaaaactccatgctcattttttttgaataaatatttcttagaatactgatcaaagtcaaaggcagcaaaaatttttctaatttcttttttaggaggataaaacaataatatacgattggaatcaaccataggctcaagattgtcttttcttgttgaaacttctagaaattcatttaaacttaaatcaaagtcataaattaaataatcatctgaaaaaagattgttaacacataaagctacaaaaaccaataaatacaaacacctttctttcatagattatacacaaagctcacaataataattcttttggaaaaatactacacatttaaactttttaacattatactaaaaatatacattaaagtaaataatacgaggagtacaaaaaatgggttttcacatttatgaaatcaaagccagacaaatcattgattctagagggaatccaacagttgaagctgatgtcattttagaagatggaacttacggaagagctgccgtaccatcaggtgcatcaacaggaattaacgaggctgttgagcttagagatggtgataagtctgtatatatgggaaaaggggttttaaaggcaattgaaaatataaaaaacataattgccccagaacttgaaggtatgagtgccttaaatcaggttgcaatcgacagaaaaatgcttgaacttgatggcacccctacaaaagaaaagcttggtgctaatgcaattttagcagtttcaatggctacagctaaagctgctgcaaagtaccttggacttaggccttatcaatatcttggagcgtacaaagccaacattttgcctacacctatgtgtaatattattaatggcggtgcacactctgacaactctgttgactttcaggagttcatgataatgccaataggagcaaaaacattcagtgaagcaataagaatggcagcagaggtttttcatacgctaaagggcattctaagtggcaaagggtatgcaacttctgttggagatgaagggggatttgctccaaatttgaaatcaaatgaagaagcttgtgaagtgattatagaggcaataaagaaggcaggatatgaacctggaaaagacattgcaatagctcttgatcccgcaacatctgagctttatgatccaaaaacaaaaaaatacgtacttaaatggtcaacaaaagaaaaacttacttccgaacaaatggttgaatattgggcaaagtgggtagaaaaatatccaatcatttcaattgaagatggaatggctgaagaagattgggatggatggaaaaaacttacagacaaaattggaaacaaaatacaacttgttggagatgatttatttgtaacaaatacctcgtttcttaaaaaaggaattgaaatgggagttgccaattcaatccttattaaggtcaatcaaattggaacactaacagaaacatttgaggctgtagaaatggctaaaaaagcgggttacacagcaatagtctctcacagatcgggagaaacagaagatacaacaatagctgatcttgtagtagctcttggaacaggacaaatcaaaactggttcactctcaagaacagatagaatagcaaaatacaatcaactcataagaatagaggaagaattggaaacaactgctgaataccacggtaagagcgtcttttattctattaaacaaaaataaatcaaatccctgtaaaagggattttttttaattaaataaaaatgtaaaatgtataaaaaaataaaattatcttttggaaaattgaaaactttttcgtgcttttttctgcccaaattttttacgttcaaccttccttgaatctcttgttaaaaacccattagatctcaaaatcatcttattagattcatcaagtttaaaaagagctcttgaaatgccgtgccttattgcccctgattgacctgaaatccctcccccataaacattaatataaagatcatatttcccaagtgtatttgtcaaaaccaaaggcgataaagccattgttcttaaattttcaagttgtatgtaagagtcaaagtctctattatttactttgatattgccactaccctctctaatgtaaactctagcaacagaagatttcctcctaccagttcccattgataaattaacattgctaaaatttgattttttcattttacctctctaaattagcttacagctttataggattttgagctttaagagtatgctctgaaccagaaaagacttttaaatttctaaaaagattacgccccaaagggccttttggcaacatacccttaatagcaatttcaagaggagcacaaggctttctctctgacaatgttctaaaagtgtcagaataaagacctccaggatatcttgaatgcctataataaagtttttgttgatattttttccccgtcagcttaactttagaagcattaataatgataacattgtcacctaaatcttgatggggagtataataagctttatgtttgcctcttaaaattttaacaacatccacagcaactttacctaaaattctatctgctgcatcaattacataccattttttctcaacagtctttggcttgatccaaatcgtatcattattggttattttattcataatagcgctataccctttataattttatgcataaatctcattcattgtattatttgtaaggatcactgtcaagcccatcaataaacttatttttaagagcaaaacaaagttttttaaaattatctagatctcctttagagaacttcaggggaacaatagatggaatactaaaatttggactaattaaatacccaaatttgagaaattcattaaaaatttcagcatgataacaagcatcataaagaggaagcatatacctatcagctattctaaataaaggtgtggcaaaagaattaaaatcaatatcgatatttttcttataaaataaaagcttgcttaatgtatgtctagctaaagataaagttacagcatcaaaattatctttaaattctatttttctagaaagattatccataacaacaatgctaacagacataaaatcaggcaaaggaatattaaaaatcataggatatttaatattactaaatcctactctaaactcatatattccttcttctttttcccagggcataaaaaatttatttttaccagttaaagataataaaaattcttttgcatctttttctagcttaaaaatataaacagacccagcctctttaaaaaaagtaaataccaaattgataaactgatttttaaaaacagaaggataaggggatatcaaaccccttgacatagtttgtttaaaaaggcgatttaaaccttgaaccctataacctaaaaaatttcttccaccatttaaatataaatccaaatacctcttaccatgaatatcgtaaagataaaaaaatcttgcccttttaatcactggtaaattatctattaaaggcaaatcatacatttgataaactttctaaaagaatttcatttgcaagtataggattaatctttcctgaagattttttcattatttgccccatcataaatttgatagcatggtctttgccctttttgtaaagttcaattgatttaggattttcatctaaaacttcaagcacaatctgcttaataacaaacttatcacttacttgctctaattgattttcacttataacaacagaggcagaaactcctctagtcatcatctctgaaaataccctttttgccattttgccacttattttgccagcaacaataaattcaacaagctctgtaatatagcttggaagcaaattaaattcaagaacactaattcctttatcattaagaacgcttaaaacttcagacaatatccaattggctacttttttgggatcgcttgaattaataacagcctcttcaaaatatttaagcagatgcttatctgctgttaaagtaataacatcaaaatcacttagcccatattggcccttaagcctaattcttgcatgaaatggaagttcaatcaactttaaatttttaatattatcaatataagaatcatcaatctctattaaaggcaggtcgggttcttgaaaatagcgataatcagatactgtctctttatttctttgaataaccgttactccgctcctatcatcaaatcctctagtgtgcttaccacaactattaagagttttcttaaattgaatccactcctgttgctgccttaattcttcatattcaatggccgctttaatagatttaaaagaatttaaattctttatttcagctataggagttttatgttcaacaccattctctttaacaattaaattaacatttacatcgcatctaaaagaaccattctccatattacattcggacaaatcaagatacctaaaaatttctcttaaagagcttaggaaagcaactgcttcatctccactgttaatatctggagcagaaacaatctcaagcaaaggagcacccgagcgattaaaatcaacataactttgattttcactgtccagtaaatgtagactcttgccagaatcttcttccatatgaattctaataatgttaatctttttgggtccagaaggggtttcaatcaataagcttcccccctcacaaattggcttatcattttgcgagatttgatatccttttggcaaatctggataataataatgctttctatcaaatttaacaacatttctaatctttgaatttgtggcatgccccgctaaaattgcactattaataagctctacattcacacttggtaatgaacctggcaatccaagacaaattggacaaacacgagagttgggaactcctccaaactcatttttacatccacaaaaagcctttgtttttaaacccagttgaacatgaatttctaatccaataactaatttatattccattcaatcctaattccctaatcacattttttgaaaaacttaaaagttcaaaatcctttttgctacgcccaataatttgcatcccaattgacaatccttcctcatccttagaatatggaagcgaaatagcaggggctccaataagatttgcaataacagtacaaatatctgaataatacattttaacaggatcatcaaaatccaaaccaagtctaaaaggtttaacaaagcttgttggggtaataataaaatcacagctttcaaaaagcttgttaaatttaggaataatcaaattttgaagaatttcacaagcttttgcataatatttagaatcatacctttctgataacaaataatttccaagaacaatacgccttttaacttcttctgacaagaaattgctcctatgtttaaaataaaaatcattaagactcaaaccttcagagattctcttgccgtaacaaagtccagtataacgagcaagattggaggatgcttcaacaggagaaattatataataaattgataaaataaaattaatctcttctattgaaacttcttttatattaataccctttgacaaaaggtctaatttaaactttgcaaaactatttgcaacatttttgtccattagatcttcgctaagctctttgattacagctaaatttttaccttgcaacgactcaatttttaaaggataaaaatcatcaaaaatgtctacactagtagaatccattttatcagatccacaagtatgctttaaaattaaagcaatatcttcaatagaatgagaaaaaaatcctatttgatcaaaagacgaagcataagatgcaagcccatagcgagaaagacctccataagaaggtttaaaacccaaaattcctgaaaaagatgcgggcagcctaacagaacctccagtatcactaccaagcgaaaaaggtgcttgaaaagctgcaactacagctgcagagcctccagaactaccacctataacatattctctatttaaaggatttaaagttgcaccgtaataagaaaattcacaagtagaacccatggcaaattcatccatattggttctaccaattaaaattgctcctttattcttaagccttttaataacagtcgcatcataaggagaaatataaccttttaaaatctcagaagcacaagttaaagatttatcttgaattgaaatattatctttgactgcaataagcataccaattaaaggcaaatcttctaattcacaattttttaaacaatcgtcatacctttttgcaatctctaaagaatcatcaaaaaattcaatatatccattgatatctttatttagctcataattatttttataagcaagcaaaatatcataaattttacattttctagttaaaactaattcttgaattttggttaaagttaaattacttaagtccaacaccttatccttactccaatattttaggagatgaaaaatatccatctaaaaacgaattactaagttttttaattgcttcaatagaaagagaaaattctactttatcctcgcgcaacgtagaaatctttttcttattagcattaaaattaatttgaacctcaaaatttgaaattttattaaccaatttaataactttctcaaattttgaaataaatttatcttcactctctctactaagtgtcactaagcttaattttaagctattttttaaatgtatatctttcaaaataaacctctaaactttgacaatttttttaatatactcaggactcaaaatagctttcttaccatttctcaaactaattttaacaaactgcaagttgctttggtaccagctatcaacaactattcccttttctccattataaattatataatctccaatattaaatccaatatcccttttgttattaataaaaaaattattaaaattctcttttaaatactcagggataaagataatgtcataagagtttttgtcaatatcttggaaaaaaacagaaggcaaagtgcccttataagaacctctaaaagctcgccttaagtttaaggtaacaataagctctgatttagctcttgtgatcgcmacataaaaaagccttctctcctcttcaagtctatcttctgttaattcttcaatttcagcaggtaaaagacctttctcaagcccagaaatcacaactctatcaaattcaagccccttaacaccgtgaattgaagacaaaagtatattggacttaaaatctccagaaattaaaggagaaagtgaagaattttctaaaaatatagcaagaccttcaaacgtgcctgaatattcaattccactattaataagttcatcaatatttcttaatttttcgtccttatcaaattttctataataatctaaaagaccaaacctaattactacatcctcaataaaagcagataaattaatataattatcttcaaaaagttttttacccagctcctcataaacatttaaaaataataaaagagactctttggctctatttttaagcaaacctaaagtctttttacttgcacaaaacaaattgaaattaacatctttatcgtttaaagaactaattattttgtctagagtagtttttccaattcctctagaaggcttgtttatcattctcaagaaagatattttatctttcttgtttataaaaagcctaagcaaacaaataatatcttttatttcctctctatcataaaatttaattgatcctaaaaccttgtatgggatattcttctttaaaaaagatgtttcaaaatgaaaagattgagaattaaatctataaagtattgctgtcttaatatcattggaaataagcaaattagaaaaatattcagcttcatctgaagtgctttgaaaaactaaaaatttcatccttttattagaactattttgagttgttatttgcttttcatatctatttttattttttgaaataacctcatttgcaatgcccactatatttgaatttgaacgataattttgcactaaataaaatttaataacattgtcaaaagttttttcaaattcaagaatattttcaattctagctcccctaaaagaatatattgactgatcttcatctcctacgaccataaaatacataccatctaaataaagttcttttaaaaataaaaattgtgaataatttgtatcttgatattcatctacaaaaataactttaaatctagattgaatagactcttttaaagatttagattgcctcagcattaaaataggcttaataataagatctgagaaatcaaaagcattatttttagctttctcttcctcataaattttaatatactcatattccttttctgtaaattgaataaatttttctaagaaaaaattttctttgtcttttaaaatcaaagctgcaatatgttttgccatttcaagatttggagcaagatcaatttgtttaacaaatttaacaacatcattagtatcccaaattgtaaaatttgaatcgtaattttcgttaaaatccttatagtaaactctcaaaagccaagacccaaaagaatgaaaagtttgaatatgaagttttttgtcaaattttaaaagatcatttatcctatcattcatttcatttgcagctttattggtaaaagttaaagctaaaatttcattgggatctatattcatatatttgattaaataaacaatttttgcaattataactcttgttttaccacttccaggccctgctaaaacaagcattggatttttacttttactaaaaacaattttttcttgagaagtatttaagctagaaaaaaatttttttattttatccatcactaataaacttcagaaaccttaagatcaaaccctgagggggtctttacccaaaaaaattgaacagcaaaaatttcttttccctgctcttttaaaaaaggagtaatgtctctgtcattaagaatgatattaacatcagaaagtcttgaaaaaaatagtatcaaagatttttcaaaagctaaattaataggaatacctttggatgcaaaaagagacttcccataaagattgttttcatcggcatatctaaaaaatgtatcatttaaaaaatcgattttcaaatcaacatttgaaagtttttgagaagaatatagggtaagataattgctgctcggcaatttttcagttcccttaacatcaaactgccaatttaaaatattaaatctattgtcaatattagtttcagatacatatttaacatttaaagcaaaagactctaaacttacatgagctattttcaacttatcataataataattctcataaataattttgactctaatattatcatcaagatttatctctttaaactctcctaaatttaaaatattcttactttttttagactcatcaacaataactaaatcatcgccaataaacgatgctctatattttgcaatatcatcactatacgttaaagataaaaaatctccctctttaagagaaacgttccaaaaattctttttatcaaaagacacttcatgaatatttgaaattatcttttcatcctgactaagattgaaaaattttttaaaatagccttccacttctctaaaatagagaaacacaaataataaaagaacaccaacaatgcctaaaaagactttaaaaatacttaaagattctaaactaaaaaaaaatatttttttttctgaaactttattgtcgcttaaaaatcctaaatttgaaattttatcttcagatttaatcccaatataactattattaagtctacttttataatccttaaaaagtgttgatatcaatctagaatcaatgtctaaatattcgctataagttcttaaaaatccaacagccaaaacttcgtttgggaaaatttcaatattagattcttcaagagccttaagatacttaatagaaattttaatatcctcagctaccatttcaagagtcaaatttttactatctctaacttttctcaaataactcccaaatttaataaaatcattttctttcatagatttaaaccttaattttttttaatatcatataaaaaattatctaccttatttgaagattttggaggatcatatttaaatttgctatcaagaattccaacattaaacttcacagcagtcaaatcaataactatttcgcgcccaccactagtaggaaaagcagtaattcttctaattattccatccggagcaaaagcaataataaaagaattaatagtagcagcccccttgtaaagctttctagaaaaggttaatttaatatattttccaggctcagatgaatcgagatcttctaaatttggagaattggtataagatacgctatactcactatttaaaactttcataagacctcccccactactaccctttaataattgctgattaaaagaagtcccaagagatggaacataaactgtcaaaaattcaccatcacttacaaaaacttgattatttgaatctaaattgataataaacttgtctggaaacttataaagcaaaacacctgtttgctttaacccctttaaagtaaaattaattgttgcttgcatgtcctctatattttgatatttagcataaattccttcaaaatattgatttgcagatatttgagaaaacacaacaacaggatacaaaactaataaaagtattgtttttatcattctatgaactcttattattaagcttaagctattaacaaaactacatttaaactatttattgtcaataaactttatttccataatactacatatcatggaaataaactattattaatagtactagtttaatacataaaataaaaatttaaagcttagatataaacaccttgaaagaattaggatttgataaaaatgtctttgaattacactgaaataaatactttgattaaagaaattcctttcacaaactctttaataacaaaaataatacaaccggattacaaaagtttggttttagagatttacaataaaattgacaataaaaaatttaaaatactaatctgcttaaatccaaacactacaagattccatataacaaaaaaaaatttcaaaaagaatgctttaaaattaagattttctgacttcttaaaatcaaaaattcaaaatggaaaaattataaaagctttccaaatgaaaaatgaaagaatcatttctcttgagattttgcaaaaagatatgattatcttatttattaaattgtggccatcctcgcccaatataatagctacaaattcaaactttaaaatactagatgcatattacagaaggccaaaaataaaagaaacaacaggtgaaatctttttaaaagctaaagaaatacatgaaagcaataaaatgtctgataaaaaaattatggaactaaaggaagaatataataataccagctatacatcttattctgaatttcttgaaaattactacgaatcgcttaatgatcaaattaaaaaaaccaatataaaagaattgcttattgaaaaatataaaaaagagttaattgttttagaaaaaagaatagactctttaaaacaacaaattaaactgcttgaaaacattgaaaacgaaaaggaaaaaggcgaattgattttattaaatattaacaaaatacaaaaagggattaaagaaataaacctcttaaattataaagaagaaaaaattaaaatatccttaaaccaatcattatcaccaaaagaaaatgccttgcaatattttaaagcatataaaaagggcaaaaattctttcaaaaccatacaaaatcaattaaaagataatctagataaatttaatttaattcaatcaaaaataacaatgttaaaagtcgaaaatttaattccggaagaagaatataatcaagaaaaaactgctattaaagaaaaagaaaaaacgccaaaaataggcttgcattttacctattgtggatttgaaattcttattggaagaaacgcaaaagaaaacgataaacttttaagacattgcgttaaaggaaatgactattggcttcatacaagagattatcctggagcttatgtttttattaaaaatcaaaaaaataaaactcctagccttgatgtccttttaggtgctggtaatttatgcgtattttacacaaaattagcaaaaaaatcgggaaaagccgatctttactacactcaagttaaaaatttaagaagagttaaaaataaaaagctgggccttgtaattccaaaagcagaaaaaaatttacatattaagctagatgaaaatctaataaaaaaaataaaaaatcaaacctaaacactgcttatagcaaagtaaagttttgaattttttacaaaatattgttattcaatgacaaaaagcataaaatttataaaagtggaggaagaactttatgatttcaaagttaacaaaaattgtagcaacaatatctgatcttagatgcgaaccagaacatataaaagatttacacgatgcaggggtaaatgttataagactaaatactgctcatcaatcacacgaagatacaataaaagtaatagacaatgttagaaaaatttcaaataaaatagctttaatgattgatacaaaaggaccagaagttagaacagcaaatattgaaaatcctattattgtaaaaactggagacaaggtaatcatttcaacctcgcctattaatgagcctaataactttcaaaccaattatgatggatttgttaaagaagtaccccaaggatctaaagtgctaattgatgacggtgaacttgaaatgactgttgttgccaaattgcctgacagattaatttgtgaaattaaaaatgacggccaaattaaaaataaaaaatcaatcaatacccccggaatttctcttaagctacaatcagtaaccgaaaaagacaaaggatttattgagcttgcagcaaaatataatgttgattttattgcccattcgtttgtaagacattccaaagacgttcaagatgttcaagaaattttaactgcctctggaaatcctgatgtaaaaattatatccaaaatcgaaaatcaagagggaattgacaacattgaagaaattgcaaaagcttcttacggaataatggttgcaaggggagacatgggagttgaaattcctgcagaagatgtacccattgctcaacttaaaataacacaaacctgtataaagtatggaatacccgtgattacagcaactcaaatgcttcatacaatgattgaaaatccaagacctactagagcagaagtgtctgacatcgctaacgctattttaaacggcacagacgcaattatgttatccggagaaaccgcctacgggaaatatccaattgaagctgtaaaaatgatgacaagcattgctaaaaaagttgaaaaacacagaaaaatgaccttatataaggatgaacttttttacgataaaagtatcacaagaaactatattatcaaatgtgcaattgatgccacaaaacttatggacataaaagcaattattgtagattctctaaaaggcaaaaccgcaagaataatggcaacctacagagcaagtgttccattattcattacaacaaatagcgaaagactagcaagagaattagcattatcttacggggtttattctaatcttgtagacaataatttcaaaagaactaccgaatttgtagtaacttctcttaaaatgttaaaagaacaaggtgttgttaatgacaaagatactgtaataattatttctggaaatccaaatagaaatattgaaaaaggaacagaatttatggaaataaacacagtagaagatgcaatcaaaggacgaaatatataaagcaagctagaaactccttggttgaaaacatattttattcagataatacaaacgacttgtcatttaagttggaagaaaaaaaaactcacaaagccctcctaacaagttatgggagctatgagttttttttaaaaaatgaatgcttgtttaaaaaaataatatcaaatcaaactaataatgtatttataatctctgaggccaaaagcaattttttaattaatatatccaatcacaatgtgtggaaaatttttaataaaaatattaaagtaaacctaaagatattaaaattattaaaaaccttaaattttattaatatagacgataaattaatcgaaaatgatcataaaattgaaattacattgaattttattagcaacataaaggaaaacataaaaataattccaataatttttggaaaaacttgcaataaacatttactaaaattttgcgagtttttaaaaccttttataaacagagaagaaaattcatttatttttctatcttgctttatttcaaaatctacaaatataaaaaaagccttaaagtttgaagaaaatttaaagcatatccttcttgaaaaaaaattgcctaatcttaacctaatactagaaaactataaatcaaaaaaaatatttccggaaaatataaatgcaatcatgaccatttcaagcctttttaaacatttcgaatttacagactcaaaaataacatttaactccccagaatacttgatatcaaacagtattctaataagataaaattatcaaaactaaaatttataaaaagttttctatttttttgcagtttttctttaaaaaagcatcaagccctatctttgaaatacttcttagcgcattagcagaaaccttaatactaacacttcttccaagatttggaataaaaaattttttatttattaaattaaccttaaaggttcttttggtttttactccaatatgttgtccagctccaccttttttcttggcaagccctttccttggaacattgtttccaaacatagttttttttcctgttatctcacacttcctagccattttaacactccttcaaattaagattttttctccaaatataaatccattaactttaaaaataaagctaaactacccaaaatatttttcatcatacctccaaagtttaaattgtttccatagcttttagcaagatccatatcaagctctttccaattataaatcagctctctttccaaagagacttttgaatagtctgaaagacaatcttgcaaacgctgctcaatagaatatattttggaataatattcgcttgatatagcaaacgcctttttattaacatctgctattatatttaacaacaatttctccgaagatttatcccccaaagaagctctgtgcaataatgcatttattctattgccataaccgccttgttcccccaaattagaatcaaaatcaataagacttgcataaatattaatcaaagcatgcatgtcgttagacatttctcttgaaagctctataagcttccattgtcctttaataataagtaaattaataatatcattaagatcttttttaacaaaataaatagtatatgttctcaaataaactaaaagttcgcaataaatataccccgtagtgctcataattttagatacaatcttttcattcattttttcattataattatccaaatttaaaaaagatattcctgggaaaagctgctcggctaatattttagatttattatttttttgcaaaactttaatcttttcaatttcagtggcaacatgcttagtaagatcattaaaaaacattcttgctattggattgggtttttgcccaacagaaatagggaaataatctggatccccactaacatatcttattagatataaaatttctttactcttatttatatccaaaatagaagaaataaccttaatccatacattagacttaataggaaaatcttctttattcccataaatttctaaaataatgtcataaaggtttttccaaatagaaatattcttaatgcaagaaatacattctaacaaatctttaagatcatctataataactccacaacctatagagctgaatctaggcctatacacaaaatcatcttctggaagcaagttgtcaaaatttttaagaaccaaatgatattgatataagactaaatcaaaaaaattatgcaaagcttcataagtttcatctatcaatttaatttgttcttgagttatgtttttaaacaaataagataaattattatgtaagtttttaggaagatctgaggcaaaatttatgttatcgcttgcagaaaaagaataaatataatctaaagacttcttttggttttcatttaagtatttttcaacaacaaaatgaacaattttattagaatttttatatctttgtgcaaatggccttaagggagaaaaaattttataaaaattataaagaaatctagaaaattgaggtaaagcctgaatttttgaagcattaaaaaaattacttactctgcctaaactaactttaacttcttttaaccttttttgctttatttgctcagaagtaagttctttattaatactaaacatagaaagtataaaatcaaataaacccaaattcatcatccccctaaaagctcttaagccaccttactctaatttccaattaagcatggaaattaatataactataaaaattatacataatttattgtaaaataaaagaaaaaacttgaataattttatgagaataaaaaatttaatactaatagcaattttattaattagccctagctgttcaacaaataagaacatcgttgtactaactgacaataaaacaataccattttatataaatcaatttaatatagaaaataaagcaaattttataattaagtttagaaataatattgatctgcaaacaatagaaaaagaaaatgcacaaataattatttctaaaaacattggtaacacaaatattgctaaccattttaaatctgtaaaaatcaattataatccagattatcctatcttaaagcatattttcaagcaatttaactacaaaattattccattgggctttgacattcctattttaatctataaaaatacacatcatattaaaaaatacataaacactaaatatctaaaagaagaatacgaaaatttcattaaagatggaaaattttttatatcgccttatgtttctgaaaatttattttatgtgatttctcaaataaataatgtgagattttcttttgaaaaaaataaattaaattataatgagaatcaaattttaaaaatgctagaatatttctcatcatttttaaatacaaaacaaatggacttgcaaaaagatttctttaataaatacggctacctaaagttaaataaaatattgcttaataaaaaatctcttttaatagcaggattgagcgatataaccttctacaatagcttaagcgaacaagagaagtcacaaataaaattttcctatttaataaacgataacaatgaaattgttatctcaaacccaaattttattggcattttagaaacatctgttttaactaaaaaatttatcaactggatattgtataaaaaaactcaaaaaaccctaattggatttaacaatcaatcccaatcaaatatatgttttggatttgccaatggttttaccccttacaaagaattaaatttaaaaataaaacattcaattgatggaatatctccttttattattgacgaaactcaaatcaatagccattcctatgtattaagcaaaaaaacaattgaaaaagaaaacttactaataaatgaatggtttttctctaaagctaataatctaaaaaaaaataaaaattaaataagtctttccttgtaattcaaagtaattattttaaaaataagaaaaaacaataatgcagaaagaatagctaaagatacgtaaacgctattaaaaacatatataagaagagaggtaaaaacaattagaaaataatttacaaaaagacaagtaatccctgagaaaatagctatcattaatgaaactagaaaaatcatagccttggaattgaaattaaattctattttagaaaacaaagagataaaaaatgcccctattaaaactagcgaaataggagaaatcagcaaaaccaaacttaaggaaaaagtattaattaatttcaaatttaatatagcaaccctatgaaaagcgcttggcaaattttgaatttttaaaaaaaatccaaactcagtaaaatttgaaaataaagctaaattttctacattctcattaattttgacaacctctaaaacatttgtatcaaagctatccgtagacacaaagaccttggtaagagtaatttcgctctgctcattgtctttatctaaaatattttgatacacagaattacccttcaaagtagcaaatggaattttaatatgtaatataacattccctgtattattaaatctaataagttcaaaattttttattattttagaatgattgttaaaggccacaactttttgcatataaatataatcataaaaacctctcttagaatctggttgcaataaaaatacatcgtttattccgtaatattcaaaatatttttcaatctcatcaaaaaaaagatatcttttcctaagcttttcaagagatttatttttataattcaaaatttcattatcgctgggcaataacttataaagattcgaaaacccgtaataagctaatttaaatttttcagtattaagaaacaaaaaatttttttgcttttcttcggaaatcaactgcattttttctttttcaaaattcctgttttcattaataaactttaaagtcaaatttaaaagcacaacaaaattatcgtcttttgttgcaacataagcaatataagcaaaataattggctgtataataatcatttttagaaataaattcattgacaatattaaaaaaatcttgctttttaagactttgcaaaggatattttgaaaaagtttttttaactttttctaaatcaacgtcataacttggaattttactatattcagatttcactaaataataatttgttaaaagctcttcattatttacataaataattcgcattttatcatatattctaatcaaattttcaagatgctttctcttttgcttcattgaatctgtcaaatcagaagataaaaaaaatctatttgcagccaaacttatatctatatgtttaattttaagagatatttcatttgcttcactttcaagaagattatatctatcataactaaacttatactcatttctctgagcaattatataaggcaaaattaaattaaatataaaagtaaaaaagagtcctataataaaaaataatagtaaaaatgcataaagcctggaaaataaatatccattatgcgattttaaatgaatctttatttcttgctgaacaaaaaaagcaaagtaaatacaaacaataaaaataaaaaacccaaaaaaatacttataaaaaagcaaaatagaatcaaaaaaagttgctattaatttatgcttttctaaaaaattttctccaaaaaaatatgaataactaaagagcaaacctagaaaaaaacacataaaaataataaaattgctcaaaaatgcatatatttctcttttcataagctttaagaattaactacccttatataaattattatccaaatctttgctgattttaatatattctgaaacaaaaccaaataaataggtagaaaaaaaagttaaaacacaaaaaataaaaggaataaaatcagagatcatgctctttcctattattacattgtaaatcttgggaaactcaattgaataaacattataaatttttaaaaaaagtataataaaaataggataaagaaatattgcaaaactatttgaaaaaataagattaaaaacataagaaaaagcaaataacaataaagaaattcccaatatattaaaaattaaatttaaataatttagcgagagtagaaaattattcaaaatttttaaatctctgaaaagaaaatcaacaaaattattataaatcttttgctctaaaaaattattctcaacaaaatcaatcttactagaattggaaatatttgattggtaagaaaaacctttatcccctttgtcattctccgaaacgattaaaactccattaaaaccataaattctaggcctattactagaaaatattatcttatcatttaaaaaatgcacaatctcatctttaaggataaaattatcatttctattgctattaatatagtaagaatgaaaactatgactaactaaaaatcctaaataagaaaacaataaaataagaacaaagataatacaataaaaatagaaagactctctagatgaatttaaaactattccataaaagggacaagatattctcataaaagtaacaacaagggacaaaggaaaagaataaatataagcattgtaataaagactatagctaaaaatagaaaaattaaaatacaaaaacttatatttcaaataaaatgtacatataaacattaaagaaaaaaggcaaaatattaagataaacctacaaattattaaaaagatcaatcttaaagaatcaaacacagcaaatcctcccccctcgaaaattgaaaaaactttaagcctttttgttatcgaccaaaatatttttaatcttctttttagcctcttcaaagctaatttgcaaagctaagctaatctcgtgctccaatattaactcaaaatcattcaaaatccttttttcgtaaaaaggaagttctttttgagtagattttttatataaaaacttatataactttgctgtatctaaaatatcgctttttttataaaattcatgaccaccatcttttattttttttgaatctatttgcccttcaaactctttaataacatcaaaaacttcttctaccttttccctgctaaccaaagctctaattccaaaatcatcaactttagcaacaggaaccataaaaatcatatcattaaatggaaaatgtatttcataataatcaataatctcaccattaaactctttagtcctaatatccttaatcgtacctactccatgcattggataaactactgattgatttagcaaaaatgccatacttacctcataaaatatagatagttaaaatttaaaagttcataaaaaaacacttaaattggttctaatattaaatttattttcataaaataaattttcaagatatctatcattacaaaagcttattattacactaggagtaagtttattaatatttgcaaaaaacatttctttatttctctttacagcttttaaatcataatacccaataaaactaatttctttatgagattctttcaatcttaaaaattttttctttgaaatcactttatccttgtcaataatataacatgttttatgggcattttctagtatttccattaaaatgagaagaactgtatttgaatcataacaatcaatattaactcttttaaaaatcctataaaaaaatcttacaattttagaatttaaaaaaacaagagaagaatttttaatgtgatttctaaactttttaaaaatcaaagcctttagaaaagctttaagcccgataaaaattactattggaatgataaggatgccctgaaagatagacaaatctgcttataagctgctgcgactatcaaaaacatctataggcacacctaaaaaataaaatctgtctggttttgaatatatgtcttttaaattagccattataatcctctaacaatgccttaaaataagcaagcgaataaataatagccgtatctgctcgtaaaattggagtgttaaaccttacaaaattaaagcctttctccttgaaaaagacaatttcggactccgaaaagcatccttcaggacctattataattccaattttgccaaaattgtcaaaactttcattcttgcttaaaatcattccacttggatgagcaacataatatctggtagtacaaaaagaataaggtaaataaaaaaaattattataaaaattaattttaggaacaattttattaccactttgctttaaggcctcatctattatttttgaaaatcttaaaattttggcagatgcattgtttatatctattttcgacacagaacgatccgcattaataatattgatttctgaaactccaatctcaacaacctgtcttaacaccaaatctatttttctgccctttaaactagaaataaaaatacttatctcaaaattatttttttcaattttatctattttattggtagtaaacttaataaaattactaccaatctttactatttctgaggcccttaattctttatcttttaaaagaatgttcagcttatcaccctttttaagtcgtcttacattaacaagatggtgatatatttttgcatctttaacaataataaaattacctgctaaacaattctcatccaaaacaatttgcttcacaatttaattacctaatttagacaaatactcacaagctgtttttaaaactttgtcataatgtagattataaattggcaattctttattattgtcctgatagtaattaaaaaacacatacttgcctaaaaattctttatcaattttatattttggattttcttttacaagattctcaacaaaaaaatcaatctcttgttcggtaatgaattttttacccttcaaaaaaccttctatcagctttttatcaaaaatttctttatatattaatgcctcctcctcagaaaaatctggagattttatttccaaatcaggctcaattccaaccttatgaatactctttccagatggagtataatactttgagcttgtaattttaaatccaccagtataaaaaggaactacatgctgaataagccccttgccataagacttttcccctataatgtatgctctcttattgtcttttaaggctcctacaaaaacctctgatgctgaggctgatgatctgtctattaaagcaacaatttttatatttgaaggcaaaacttgttttgagcttgccttataatcaataggcttgctagaatttcttgattttgtggaaacaataattcctttagataaaatatcatccgccatttttatagctgcctgaaaatatcctccggtattaagccttaaatctaaaattaaagatttaatatttttattcttaagattatctaaagcttttctaaaatctacagaggtgtgtggattaaagcttactattcttatatagccaatatctgaattaataacgtcatacttgatygtttgtatttctatcttctctcttgtaagttcaaaatccaatgttaaattttttcccctaagaatagatactttaacttttgtgccttctttaccttttaaaagatcaacaacttgatctacttccatagaataaacactcttgccatcaacagcggtaatacaatctccagatttaattccagccttataagccggacctccttcaaaaggcgtaacaatagaaacacaagcactattaggatcaaaatcttttgccttgtcttgcttatcttgggaatgcattttttttattatagaaattccaatgccaacataatctcctactgttgtttttgaaatttcttctaaatctttttttgtcaaatattgagaataaggatcgcctagggattgaaatattccttttaaagcaccttcaaaaattacttcatcacttacaggatcaacataattttcttttacaaattcaaaagcttgaatcatcatctgctcataatttgatcttgataacttattattagattcatcaaaagcaaaaatagattcaacaattactaaagagcttatacccagagtcaataaaaaatatacacatattaaaaatttatttttcatttattcattcctaatgcaaaaattaaaacttgattttatttccataatataatattttaaaactatgttaaactcacatcctaaaaaaacacaaagcctttacagagcaggacttgttgttttacaaattactgaaagccttttaatcttagccttattatatcaagccattaataaattaattttcattaataattactccataaagtttatgttaacatttatcttatactcacctgaatttttcatggccaatttaacaacctattactttatctacgaaaaatttaaaattcttcacagcattatagtaataactaaattattccaaataatattaacattattattattcatcttgggatttatttttaaaatatacgtctatcaaacctctctagccataattttaggaattacagtagtttacctagtatttaatgtaacaatattagtgctaattaaagcaaaaataaaaaacctggagtaaagcttgattattattcctgtagccagtggtaaggggggagttggcaaatctcttttttcaacaaacatagcaatttgcctggcaaacgaaggaaaaagcgtattgcttgttgatcttgacctcggagcatctaatttgcactcaatgttaaacattatacctaaaaaaagtataggaacatttttaaaaacaaggattaatttctcagacatcattattcaatctggaattaaaaatctaaacttcattgcaggagattctgacattccagaacttgctaatatagctgcttcccaaaaaaaaatcataataaaaaatttaaaatctttaaaatatgattacttagtgattgatcttggagcaggaacagcttttaatattatagacttttttttaatgtcaaaaagaggagtaatagtaacaacaccaacagtaacagctacaatgaatgcatatttatttcttaaaaatataatatttagattgttatcaagtgtgtttaaaagaggaacaaaaggaaatgaaattctcagaacaataaaacaaaattcaatcgatcttcaaagggtttatatacctaatttgttgttaaaacttgaaagcgaagatcctgaaaattattctaaatttaacaaattgtttaggacaattagccctttcatgatatttaatatgctcaaagctcccaaagacattgaaaaaaccgaaaaaataataaaatcagcaaaaaactatttaagcataaatttacaaagtattggagcaatctataaagatgaaatagttgatcaggctttaaacagcaaaatacccatcactatatacaaacctacaagctcaacttctaaaagtataaaaaaaattgcaaaaaaattaatcgaaattgaagatttaacaaatgatgccgagcttttaaacgaagaagatttaaatgaaagttatgattttgtactaagagaggctcaagaagaatatattgaaaaaattgaataccttgaatcattgataaaaaacaaaacaatagaaagtagtgaaattattgatataataaaatctcagaaaagagaaatcgaaaccttaagaaagcaaaatatgttatttaaaaaaaagcttgttgaaaagcttgaaaaggctaaggaggtctaatgccaaattacataaattacccaagttggttacatcctgaagtaattcaaggtataccaattacatggtatagcctatcttatattttaatcatactaatctcttataagtttatttggtatcaaatacaatcagacaacgttgatattaaaaaagaagattatgaaatattcatgttctcacttgtacttggagcaattttaggaggcagactagcatctaccttagtttacgacaaatcgggaatttattattctaatccctggctaatccttttgccattcgaccagcattggaattttacaggctttagaggtatggccatccatggtggttttttgggggcaataattgctcctttaataacaataaatacaaatctcaaaaatacaaatgttcaaaaatattttctaaaactaacagactatggatcaatagctttttcttctggctacatacttggaagacttgctaatttcgcaaatgcagaactttatggaagagtaatgaaagggggaataatattccctaatgcagaaccatttgacacaaatataccgggtgtaaaagaatttgcatcatcagtagggcttgaaatttcgcctcatgacctgctaatcaaccttccaagaataccttctcaacttattgaaggatttttcgaaggacctgtaacttttctgttactatggtttttatttaaaaaaatcaaaaaatatgatggatttatttttggtgtatatgtaatgctttacgcttttttcagattctttattgaatatttaagagaaccggacaaagaacttggatttataataacctacaagccaattacaagcctgtccgaattttcttttttaaacatatcaatgggacaaattctctcgctaacgctgatgctctcaggattaatctggataatagtcactaaaaaaattgcagataaaaaaataaaaaataacaccaacttggcatacaaaaattaaaataagagcaagccaataaaatgaacaaagtcaataattatcaaaatataaattcagttataatctctaaaaaagaagttggacttagagatctcataaagcttaaatctatttttaacttaattcaaatcgtaaaatctgaaaaagctttatacagcgaatatgtaaaacaaaataatattaaattcgctattatttataattatgaaaaaccaatagatttttcaataaacattgcaaacgaattaaaaaatgcaaacaaaatccattctatcataattagcaaagaaaaatttgatgaggaatatttaaaacttgatcacatagaaataataaaagatataagcgaattagaatataagcaaagcttaatacatcaaaaaaaattattttgcgacaataaaaacacaactctggatttctttttaaatttatcagaactcataaaagaaatagtaatcatcacaaacactaaaaatgaaattatttatatcaatgaaaaaggtagtaaaaatcttaatcttccaatgaaaacctctggaaatataatcaaagtaaccgacatagatatcagagattgggaaaagctagaaaaaataaatttaagttatcacacaaattctattcctgaatttaaaaatatattaataactgattgtcttttaactttaaaaaataataaaaaactacatgtggatatatttattagcacaattgctcaaaacaatatcgataaattaataacaattaaagaaatatcaaactctaataaaatagaaaactataaatatctagaaattattgattcgcaagacgagattcaaaatgccaaagaaattgaaaaattactagtaaaccatatggatatttacaaaaaaaaaagcatatatttacttaatttagacgtatccctaacagcagaatatgaatacaaagaagatcaagaaaaacttaatgcaaaaatacttaaaataatgtattcaaaaataatgtcattatactctgaatatatttttaagttaaaacacaacaatttaatagtaatcataagcacaagtggcggagaaaagcgaataatctcaattgccaaaaaaatcaaaaaaacaattgctctggcatttaaaaaagaagatattattatattcaagttcaacattggaataatagaggtaaatttaaaagaaaacttagaattcaaaatccccaaattaatgatggctacaaaaatatcatcggaatacaaagaatctaatcccactatatacaaagaagaactaccagaagcggtgattttaaaaaatcaaaacaaaatttttcaatatatactcaaagcaataaaaaatgatttttttactctttattatcaaaaaataaatcctcttaaaaagaacttaaagcccaaaatagaaatcttgacaagactttttgaccacatgggcaaaccaattccaaacaatcaaatttttaacttaatagacaaatataatttaactgttgaggttgatacattggtggttaaaaaggctttaagagaatacaaaagctttgtatcaaaaaatggaattcacattttctcaattaacatatctccttattcactaaaatcccaaaactttcgaatctttttaagagatactttattgaaaagccaaatcccacttcaaaatatatgcttggaaataacagaaactggaattcttgaaaactttgagataataaacaaatattttcaagaattaaaaagttttggaatcaagctagcacttgatgactttggaagcggacatacatcactctcatatattaaaacactaccaatagacttacttaaaatagacggatctttcataaaagcaataaactctagtgaaatagattttgtaataataaaatctattaaaaaaatagcagatacaaaaaatataaaaattattgccgaatttgtgtataatgaggaaatattaaaaaaaataattgaactagaaatagactatgggcaaggatttttatggcacaaaccagaaccaatataaattctaaaaaagtgaaatctaaaaatatacttatgcctaaattttattaaatttcaacaaaaattattttacattgaaaaaggaataaaattaatggaaaaaaaaatagcattaattgcacacgataaaaaaaaggaagatttggtaaattttgtcaaacaaaactatctcttcttatctaaattcaagcttattgcaacaggaacaacggggtctaaaatccaacaagctaccgatcttacgatttttaaatataaatcaggccctatgggaggagatcaacaaattggagctgaagtagctgaaggaaatatcttagctatatttttctttagggatcccctaacaagccagcctcacgaaccagatgtgtcagctcttattaggctttgcgatgtacataaaataccgcttgcaaccaacgtaaaaacagcagaaattttaataaaaggacttgagagcttgattttttaaaataggctttaatttagattaaagcctataaaatcaaaaatataaattaattcgttaacataggtgaaattttttcaacgccgtcgataatgtaattaacagattcaaggaaggtcttggcatctgaattattctcatcaactgtaatttccaattttgaatttttaatattaagatctttaaaagtaccaataagatcacttttagcgccatgtaaattgctatttataatctttttaaagtcaggggtaatcccaacaaaaataaaggcttcttttccagagatactaattggagcctctcctgcataaacattgtcataaaaataaactattaactttgcattctcttttgagggtattgtttgaaaatgtccatcttcttcagaaaaataaaaaacctttatatttttccccaaactttttcgatccttttttgaatgaactactcccatagcgtgaaaaacgtgcccaatagtatgttcatctattttagaatcatcaggcttagaagagttctccgcttcttgctcctcaacatattcatttgagctatcttttgaagtacaagcaattactaaaaaaattaaaaacaatgacaaatagtttttaaaaaaaccatttttatacataaaaattctcccttataatttattaatcatattaaaattaaaagtaagtttacaataaataatttattttgtacacactttaaaaacaattaaaatgttaaaatgaaacaggaggtcttattaatatgaaaaaacaaaatccatggatatatttaaatgaagaagaaaaaaatcaaattttaaatttttctgaaagttacaaaaaatttataagcaaattcaaaacagaaagagaagttacagcctatgccctagataaagcaaaaaaattggggtttattaacgctgaagagaaaaaaaatttaatgccaggtgataaaattttttatacctgtagagaaaaatctgttgcttttgctattattggcaaaaatcccattgaagatggaatgaattttattgtttctcacacagattcaccaagacttgatgcaaaaccctcaccaatctctgaagaaaatgaacttacatttattaaaaccaactattatgggggaataaaaaagtatcagtggttatctacacccctttcaataagaggggtggtatttttaaaaaatggagaaaaggttgaaatcaatattggagacaatgaaaacgatcctgtatttgtaattcccgacatcttgcctcatcttgatagaaaaatacaaagaaataaaaaatcagatgaaattgttgaaggggaaaatctaaaaattttaattggaagcctgccaatcgaaacaaaagaaaaaaataaagttaaactggcaactttgcaactaataaaagaaaaatacaaaatagaagaagaggactttgtatcatcagaaattgaaatagtgcctgcaggaacagcaaaagacgttggatttgacaaagcgttaattggggcttacggacaagatgacaaaatatgcgtcttcacttcactagaatccatatttgatcttgaagagactccaaataaaacagccatttgctttcttgtagataaagaagaaattggttcaacaggttcaaccggactagactcaagatatcttgaatattttgtttctgacatgatcttcaaaattaaaaaatcagaatacaacaatcttcacgtccaaaaagctttgtggaattcaaaaagcatttctgctgatgtttgtgcagcaataaacccactatttagttcagttcatgacgaacaaaacgctccccaacttggctatggaatacctataatgaaatacacaggacatggtggaaaaagtatggcaagcgatgctgatgctgagcttgtttcttatattagacaattattaaataaaaacaatatagcctggcaagtagcaacactcggaaaagtagaagaaggaggaggaggaactgttgctaaattcttagctggctatggaataagaacaatagacatggggcctgctgttataagtatgcattctccaatggaaataacttctaaatttgatttatacaatgcttacttagcatataaagctttctacagagaataaaattactatggcagatttagaaaaaataaataaaattaaagtagcagagcatattgtagaatgcttcgggggaattaaaaatattaaaaacatagacaaagacctaacaagaataaaaattttagtagacagcaattctttagtcaaaagagacgatttaacaaaaaatgacaacataataggaactattaaatctaatgaacttacagaagttgtaataaattttgaaataatcgaggatgtttataataaaattttatatatgatgaatgagcaaaaacaataaagcctctgcagaggctttattttattgtctaacatctctcatatactcaataacagatttgggctccaactctttattcaaaattttatatataacgcttaacaaactattaggattgagatcacgatttaattgtttaaaaaagaaaaaaattgatttagcagccaaaactccctctggtaaatatccaattttttcaatattacttatcaagtcatctatacttaaaaagctttctaaaatgtttttgctaacaatttcattgccaaatcgtctatttcttccaaacatgcttctacaagtaacatctaaatcgccagaaccagacaaaaataaaaacgtttcaatatttcttcccccaagctccattgcaatatcttttatattatttaaggatattgaaaataaaaatgattctgtattattacctattaaattaggataattcaatttataggcatccaaaattccaaatgcaatagcaaacacattttttaaagctgctgctatttgcaccccaaaaacatcgttgctataaaataaagaaattggggttttactaaataaattaataaacaaatatgcattttctctgttattactagccgcaacaagccctgttatcacaccaagcccaacttcctcagcatgacttggaccaacaatataagtaatttcgtctttatatcctttcataattctctcagcagcttcaataactgtctgagttttaccatcaaaagtaataaacccttttgtaagtattgctagctttggttttatctccagaaaatgtaaaaattgatccaatttttttaaaatatcaacggtaaaaagagaaggtgttgcaatgaaaatataatcagacattgttacaacttcaaataaatctgaacttgcaactaaattttttggcaatttaattccctttaaatatttagtattaacattatcattattaatatcattcttaacatcttcttcaaagacccataaaaaaatattaaaatcaaatttatctgccaaagactttgaaatagctgttccccaagcacctgcccctattactgatattttcataaatactccccctataaccttataaaaactcatattttattgtttcatctaaatagatttttattttaccagaattttcaattttcttaaaaagaatttcatctattaaaagctttcccaattctttgaatataaattttctaacactttttaagctgtacccctttccataaatcttttctcgaatataatcaacaacacttttttcaaaaaaaacatcaaattttctatctcttaatatccttgcaaaataattaagttcattaaaaatgattttttcaaaatctaactcatcaatagatttaaatacaaacacatgatctattaattctaaaaactcattgggcaatctcttctttaatataaagttaaaatcattttcccccgccattttatttctaaaaccaatgctattaagctctttgctctcagcattgatacttattactattaaactttctgataagcttaccttttttccaagaccatcaaaaagtttacctgttttaaacccctctaaaaaaaaatctaaaacccttttattacatttatcaaaatctgataggaaaataatagaattagaagatttgttcaaaaatttaaaaaatctggtagattcataatatccttcattacttaaaacaggcccaatcaatctatcaagagaattaaaatcattatactcacccatgttaagactaaatttaggaattttaaactcttctgataaaatatccatcaatttgcattttcctgacccagaagcaccaataaaggcaaatattccaatagtacttctattggcaagcaaattgaattttaataatttaatatttaatatcaaatcaagtaccaagttatcatgtataataagttctttttttattctattttctaaattaattagcaattcaccatcatactcttcaaaattaaaaatattagaaccaacaatagatttaatcagatcgcaaacatcatcttttgttataatcctttttatattttcaagcttaaacttagagcctaattcatctaaaatatcaaaagctttgtctggaagaaatctatctttaatatatttttgagacatgagaatgcaagcttgtattgcctcgtctgtatattccacattatgatacctctcgtaatcttttttaatctcctgcaaaatattataagcgtcttcaaaattaggctctttgagctctatactctgaaaccttctcattaaggccttatcttttaaaaaaaattttctatattcatattctgtagtagctccaataaatttaatttttcctaaagtgagaatgggttttaacaaattggaaatatccatactgccaaatgaagtagcccctgcccctactatcatatggatttcatcaataaaaagcataactttttttcttgagcttaaaaaatctaaaaccctattcaccctactctcaagatctcccctatatttagtacccgaaacaagcctaccaatatcaagagaatagatttcataccctattaaatcctttggaacattctctatttttattttatatgcaagaccttggattaatactgtttttccaacaccaggctctccaaacaaaataggattacttttatgcttcctaagtatcacctggattaaccgagataattcttgacttctaccaattaaaggattgtattttaaatccaaagtatcaataacgtttgttaaaaaattaccaatagagtctttactttctaagaaaatattattttgatccaattcatcacgcttatcatcaaaaatatgaaagcctcctttcctttttggcgcattattatgaatatattctgcaattaattcactgtcgcctgaggcagatttagtatttacagctaaataatcatgagcttcaataagtttatcaaaaatagtcaaattaaaacccgagctaagcagcgcatctaaaatactattttttctttttttgacaagcacccacaatagatctttttcttgtattttataaggttttttataaaaaaaaagaacactaattatatcgtcatacaaataatccatactagaaacatagtctgggatataattgcctcttaagggaagtttactaaaaaattcttctagttgtttattaagtttataaaaatcaattgcacacaaattaagtagttctttaactttatcacttttaataagcccataaaaaatgtgctcttctgtaaacacaaggtgcctagattccatgaaaaacaaaaaggtgttaaaaaataaacaatttaaagctcttctatcatacatccaaaatcaactatataacaattcgtaaaaatttttttttacctactcttaattcaacttcattgttattaaaatcctttttggtaagaaggtgactctgactttctacccttttaccattaatataaacacctccagaatcaatcaatcttctgccttctgatttgctgggcacaatttttgaatctaacattaaatcaaccaataatatctcttcttttaggctagaaaagctaaatttaaaaaatggaatattgctcctatctccacttcccctaaatgcggcaaaagatgcctcttgaactttcaaggcttctgcctctccgtgaacaattttagttatctcaaaagccaaaatctctttggccttatttaaagaattccccttaaaatttgaaattaattcaatctcatcttcttctaaaaaagtaaaaagatataaaaaagttttcacatcagaatctgaagtatttctaaaatactgataaaaatcataaatactaaaaagattagaatcaagataaacagcgcctttttctgatttacccatcttttttccatcacttcttgtaattaatggaaaagtaagcccaaaagtttctgatccatttttttttctaattaggtcaacccctgaaataatattcccccattgatcatcaccaccaatttgaagtcggcaatttttaattttattaagcatataataatcataagactgcaaaagttgataattaaactcaataaatgaaagtccgaaatccatccttcttttataagtttcaaagcttaacatacgattaacagaaaaatgcatgccaacatctcttaaaaattcaatataattgagattatctaaccaatttgaattatgaataaaacattctgaagtaaacttagttattctttgaagttgattttttatcaacaaagcattattgccaatctcttctgaagataaaatctttctcatctcactttttccagaaggatcgcctatttttgctgtagaatctccaatcaaaacaattggcatgtgcccgtgttgcctaagatgcatcattgctaaaaagggaatcaaatggccaatatgaagagaactagatgttgcatcaactcctgcataaaaaactattttttccctatccattaaatcacttaaaacttttaaagatgtacattgctttaaaaatccgcgtttatgtaaaagacttaaagcaagattcatttattaaaatcctctttgtaatttaaaatctctgttttaatgtatgaatataaatcattaataaaaattctcttctgagtcatgctatttctttctctaacagtaactgtctcatcctcaatcgtattgtaatctattgttacgcaataaggagttcctatttcgtcttgacgtctataccttttacctattgttccactatcatcgtaaaatatatgaaaatcatcgcaaagctccatataaatccttctagcaatctcagtaagctcaacttttttaacaagaggaaatatagcaatcttgtaaggagccaacttgggatgtaagcgtaaaacaatacgcttgtctccatctgagagctcttcctcagaataagcatcacaaagagtcattaaaacagaccttgtaagaccagcagaagtctcaataacataaggcacatatttctcttttgtcaacaaatcatgatactcaaatactttgggcttattagaaaatttagcgtgctgagttaaatcataattacctctattgtgaattccttctacttcctgaaatccaaacggaaattcatactcaatatcaaatgcagcttttgcataatgagcaagctgcgttgaatcatgcgccttaaatcttaatctatcgggactaattttaagagtttctataaaaaaattcattctattttgctgccaataacaaaaccactcgtctatttgcttgggatgaacaaaaaactgcatttccatttgctcaaactcacaagttctaaatataaaatttttagtaactatctcatttctaaacgctttacctacctgagcaatcccaaaaggaatcttaagccttgaagaatccaaaacatttctaaaattaacaaaaattccttgtgctgtctcaggccttaaataaacttcactagaactatcctccactactccaatgtgggtcttaaacattaaattaaaacttcttggggaggtaaaattatttccaactttgcaattcggacaattttttgacaaatcaataaaatcagctctaaatctacttttacaatctttgcaatcaaccatagaatccgaaaaaccatcaacatgaccagatgctctccaaatttcagggcgcataaaaatagcactatctaaacctacaatattttcatgcaagtacaccatgctcttccaccactctttctttatattctttttaagctcaacccccaaaggaccataatcccaagctcctgaaaggcccccgtaaacctctgaagactgaaatacaaatccttttctttttgcaagagaaataatatcttccattctaaccataaaaatatccttaatagctattcatttattcttaaaaattcctgtgctaattttattctttcaaaaactttagacttgcctatcaattttaaagaatcaaaaagcggcggagagactttgctaccaagcgctgcaattctaataggaagaagaatttctcccaatttaaaaccattactctcagcaaaatcataaaaaattttatcattttcttctgatgatcttttttcaaacccttctaaaataggctttattaattctaaaatagaacaaacttctttagctgttttttttctacttaaaaactcatctaaattccaagatttaatgtcctcataaaaaaatttagtcatatttaaagcatcacttaattttttaattctactctttataagaggaattaataactttaatttttgattttcttccaaagtactaggcttagaaacatacccttttttttggaaaaaagggagtaaaagattaaataaatcttcatcttttttttctctaatatagtagctattgaaaaaatccaatttatgataatcaaaaatagcaggagatttattgatcttctcaattgaaaaaaattgctcaagatcattttttgaaaaaaattctctcttatcgtcgtaagaccagccaagcaaagtaacataattaataatagcctctggaagatacccatcttcaataaactgtcttaaagctgttgagccatgtcttttgcttaatttttgaccatcatttcccataaccattggaaggtgacaataaatagggggtttccatttaaaagccttataaagaagtacgtgcaatggacctgaagaaacccattcttgagcccttaatacatgggtaattttcattaaataatcatcaacaacattggcaagatgataagtcggcaatccatctgacttaagaattacaggatcaggactaatgtctttattcgcccatgtaatccttccaagtaaaatatcatcaaagctggtatctccttctaaaggaattttaaatctaacaacaggcttgatttttttaattagtgcattctcaacctcttcattacttaaattcctgcaatgcctatcatatccaggtggcatcttattaatattttgaattttcttaattctttcaagcctttcgggactgcaataacaataataagcatgcccagattcaatcaaatatttagcatattgcttatatattgcacttctttgagactgaacataaggcgcataatcaccccctacaacagggccttcatcaaaagaaatgccaagccatttaagacttgaataaagatcattttcagcttctggagaatacctgctctgatctgtatcctcaattctaagcaaaaatttacctccgcaagactttgcaaaaaaataattaaacaaagctgttctaatcccgccaatatgttgtaaacccgttggagaaggcgcataacgaactcttgtactcaaaacacaactcctttaataaaaaacatcttttttagaaaaatcataaatataataaaaaacaacaaaaaataaattcgaaccaagtagctttgtatgcttagaatctatcctgtttttaaatttatagtatcgatttctaatctcaattttcttgctttcaagcaaatcaaaagatgtttttgattttcgcaataaataataaaaataaatagtaaaaatatcatttttcaaaaaaaacttatctaaaaaatttaccaactcttttagctttgagtgctcttcaaatgacaacatactaagagcctcacaatatttcacccacttatttctactgtacttgtaatttaaaattaaactagaagccttttctttttctctaaagctaataagaacagaataaagctctattattgttttatgtcttaatctagtgtcttttaaataaaaataaagctcatcaaggctttttttatcttgttttattaaaataaacctaagaagaatagatatttcaaaaacacttttaagctttttgcgaaccattttaagcttcaaaaaagtgaatgcatcttccatcccatttaaaataaaatacaatcttggaaaaaaatattgggaataaataacattaaaaacaatcactaataaaaaataaactacaataaattggtaattaaacaaaatgaagcttaatttcatttgaaatcttaaaattgccagaaaataaataaataatccaagaaaaataatattaaaacctaagcgtattttttctaccataaaaatctcttcaaaaaagcttaattcaaaaattgagatataataaatacattatactaatagatagacaattaataaataatatgatatacatggttaatagagcttaatttcaagggaataaatgcaaaattctgaaagcattattaaaaatataaaaaattcatcatatttaatagacaaggaatttttagtttggcctgagaatgcatttattggagacaaaaacattgagcttattgaaaaatggaatctaaagtcatacattaaagagagaaaaaattttttcagtgacgattctgttaaaaaagaatatgaagaaatacacaaaaaattcaacgaagaggctatttccagttatcatgtaataataagcaatttagaagaaatttatgaaaattgcaaaagaaataaaaaaatatattaccaagatattatgcctactgtaaaaaaagtaatagaattttacaagaaacagaagaaaatttttatcaaatattttagaattcccaagctttctgcaaactatcacattattcattcggtaaatacagctatcctaacagtagcccttggcaatgaaatgggactaaataactataaaacagtagagctttgtagtattgctcttttacataaaataggatttttatttattccatcaaaaatcagcgaaaaaaaagaagcattaactgaggaagaactagaaataataaaaaaatatcccataataagctacaaaatagcttcaacgagtaacttatcacgatcaatatgtttgacacttttaacacataaagaaaatctagacggaactggctatcctaaaggattaacaagtgaaaatatcagcatagaatcaaatataataggcgctgctagtgcctattctgctatcattttagataaggcatacaaaaaatcttttaattctggagcatctattattgaattaatcaaagatgctgacaaaaaatttgacaaaagggttttgaagctaataatcaatgcaatatcttcttgtcccttagactttattgtagaacttaatgacaattctatagccaaaatagtagatatagatgagtctaacccaaatcttccatacatcaactacataataaaaaatggaaaagttatagacaaaaatgaacaatctagtgttcaatctataccaaatacaaatacaggaataaaaaaaatactcaatcaaaatgaaatagagctaattaaaaataaatattctttaatagatattatataagacacttaaaaggagaaaaaatatgattttgataatatcagctatgcaagaagaatcagaagaaataaataaaatacttgacaacaaagaagaaattgtattaaacgactacttagaaaataaaaagatttataaaggaaaaattctaggaaaagatgtaatatctttaactacaggaattggaaaagttaacgcagcaacttggagtagtcaaattatctctaagtataaaatcactcacataataaactctggaagttctggggggataaaagaaaactctaaccttaaaatattagacattatagtatcctcagaaacagcatactatgactttgacttaactaagtttggacacaaaataggacaagtccctaatttgccacaaaagtttaaagcagatgaagagctacttaaaaaagtggccaatattgttgacaacaagcttttaaacattgatatccatattggcttaatactaacaggagatcaatttgttgacaatgaaaaaaatcttgaaacaattaaaaaaaatttcaaagatgctttagctgtagatatggaaggagctgcaatagctcaagtagcacacatatttaaaataccattcataataattcgttcaatttctgatctaccaaacaataaagacaaccatatagactttaataaatttttaaaaacatcatcaataaattcaagcaaaatgacaaaggaacttattaggctaatatgaataaaataatagcagcgaaccaaactttaacttctgaggctgtatctgaaggacatccagacaaaattgcagatcaaatctctgatgccatccttgatgaaatactaaaagaagataaaaatgcaaaagtagcttgcgaggtcataattgcacaaaatttagtagtaatagcaggagaaataaatagtcctgtaaaaaaaaacatagatataaaagaggttgctaagaatatcatcaaagatataggctatacaaatattgattatgggcttgattacaaaacaataacggtaatagacgctattggcaatcaatcacgtgacattataaacgcaattgaaaaaaagggatccaatgcccttggagcaggggatcagggaataatatttggatatgcctgcgatgaaacaaaaaattttttacctgctccttatgaactagccaattcaattctaaaaaaagctagcaatcttagaaaatcaggagcaataaaatggttaaggcctgactcaaaatctcaagttaccatagaatacgataaaaacagaaaccctgtaaaaataaaaaatattatagtctctcatcaacaccatccaaacatctcccaaaaactaatacaacaaacaataattgaagaaatcatcaagcccactgttcaagacaagtcaatgcttgatgaaaatactgcttattgcattaatccttctggaaattttgtaattggaggccctaccggagacactgggcttacaggaagaaaaattattgcagatagctatggaggatttgcaagacacggagggggagcatacagcggaaaagatgccacaaaagtagatagatcagctgcctacatggcaagatatattgcaaaaaatatggtggcagccggaatttctaaagaatttgaactacagctcgcatatgcaattggaattgaaaacccaatatctattcaaataactgggggaataaatgatcctaaatatgcaaacaaaatattaaattttattgttaataacttcgatttaactcccaacggtataattgaaaaattaaaactaaaacaacccatatatcttaaaacttgcacttatggtcattttggaaaaaatgaatttgaatgggaaaaattagattttgtaaaaaaaatacaaacagcgctaaaaaaatgaaaaaaataacaagctttacaatagatcatacaaaactcaaccctggcatatatgtctcaagaaaagatacctttgaaaatgtaatatttactacaatagacattagaatcaaagctcccaacatcgaaccaataattgaaaacgcagcaatacatacaatagagcacataggagctactttacttagaaataatgaagtttggaccgaaaaaatagtatattttggccctatgggatgcagaactggtttttacttaataatttttggagactatgaaagtaaagatcttgttgacttagtctcatggcttttttccgaaatcgtaaatttttcagaacctatcccaggcgcaagtgataaggaatgcggaaattacaaagaacataaccttgatatggctaaatatgaatcttctaaatacttacaaatattaaacaatattaaagaagaaaatttaaaatatccttagctcataaaatttacaaaatagaaagtatttcgctttcattttttgttgctacatcaaactgaaaaataaatcctaatgttattttatgcatttgatttaaaagtaaaggtttgttgtaaaaaattggagagattgtatattccaaaaaaataaaatctacattaattctagctccaatgtctattcccaaaacaaaattatccaataatacccaatcacgcgaatctacaaaacaaatttttgcaccaatgtatgaaaattttaaacctgtaaaaaagattaaactaaacattggggtataggataaaaagaaataattaccatacattctcagtgaaaatgaaacatcttttattatgaaataatttagagaatgcttcaaatatgcttgatcatccaacataaatataatctcattggtataaggagtatggcttggtaaaaatttaatatctaaattaaattctccaccaaatgctaaattttgagaaacattaacaccaactccactgaaaaattgatacttaagtctttcataaaagaataaatcttgagtaaaattgtcaacaccaagcccaactccactgtatacattaagatagctaggaattcctgaataaattctaaatgcattaagcataaaaacaaaaaagaataaaaagtttcttctcataaagaatccttttgggcaaaataaaattaaatattcatacttatttgcatagacaactctttaaatttttcaacttcaagattaagtttattgcctctcttaaaaccaaaaccatcgtttttaaatcttggaattacatgaaaatgagtatgaaaaacctcttgccctgcgccagcccccaaagcagaataaatatttattccaccataaatgcttgagtttattctttttaaagcatttgaaatttttttacatacctttaaaactctctcgttaaatttatcatccatgtttaataaactctcactatgttctttgggaataacaagagtatgcccaacagttaaaggattaatatctaaaaatgctaaaactaaatcgtcctcataaactttataactaggaagctctttgtttattattttacaaaaaatacaatcatacattaaaaatatcctattataaaaaaatagcaatcaacatatttaaatgaaatttaaacagcatagctaactaaaacccattttgctatattaaaataagctattaaagtaatagcatctgcaattgtagtgattaaagggcctgccataagtgctggatccaactttaaaagtttagcaacaatgggtaaaagacctcccaatatctttgctactgtcaaacttaccatcaagcaagatgaaactacaaaagctattttcagcttatcagaatggtgtggagctacaaaaaagacaattcttaaaaaattaacactagcaagaattgctcccactagaatgctaacacatatttcctttaaaaacactttaaaaaaatcttttaccttgacagtaccaagagcaagctcacgaattattagcgcagatgcctgagagccggcattgcctgaagtatccattaaaaggggaataaaattagctaaaaccactaaagacaacattaaattttgataatttgaaataattgtagctgtaaaagtagaagacaccataagaactaaaagccaaattattctattttttgtcataactaaaatagaagtatcaagataagatgtatctaaaggcttaacagctgcaatcatttgaaaatcttcagtatttacagattgaataacctctaaaatgtcatcaataataataacccctatcattctcccctcattatcaacaacaggaacactggtaatatcatgtttttgaaaaagaagtgcaacatcttctttctcatcattaacccccacaatataaaacccactacttctcattattgacgagagaataacatcatctttagccaatattaaatcttcaatttttataactccttttaaatgcttttcatcatctgtaatataataagtgtaaatatcttctttggttttagctacccttctaatataatcaagagctttgccaactgtgaaatcttctttaagctcaacatactcaattgttacgatcgaacctgcagaatcatcactgtaagacaaaaatttattaataatttctctattctcttctgtagaacttgccaaaaatctctgaacaacatttgcaggaacctcttccaaaaggtcaataacatcatcaagattcagctcatcaatcatttcacttatttctttattggtaaaagaatttgctaatttattttttgtagattggtcaaaattagaaaaagtttcaactgctattttttttggcaaaaatctgtagagtaaaatcaattcagttccattaagtcttttaagagcctcagcaatatcmaaggaatcmtgctttaaaaatttttctttaattttagaatagctcttctctttaagaaaaattctcaactcatcaatatctatcattaaaaggcctccaaaaatttaaattttacaagacatttaatgaatctaattcatcmaagcttatccaataacatagaacatcttcctgagggaataggaagggttttttcttttttatttaatatatttattgtaaaataataaagtttttcagattccatttttatttcccaacctcttttccccttattgcaaattattgtagtttgattctttttaagagataagctttctatccccataatctcaagagtgggtatattccaatatacagttttatcaggcaaactaattgtaagcccaataatattttctatcattaagctaatactaaaaagtgcaagataacaaataagacctttctcggtataagtttttttattagaatcaaaatatgcaggtccttcttgcataggtctataagcttcccaaatgtgccccttaattttattaaaaggcattaaagtgtctaatatataatacaaatgtcttatagtaaattctcttgcaatatttgcacgaccacaatattcaagccctttgattacaaaaaaattcatataagtataaactgaaccataatatccattgccatcctcactaaaacctggctcactaacagaaagtgttggaaaaggatttggagtcccaaaatgattagtactttttaaataaaaaatcattctttctattctgtcctcactgggaatctcagaaagcattgggaaaaaacctactattgtcttgatttcaagaatattttcattaacatcaagatcataataaaatccatctttttcgctccacattaaagaattaattttgaccttaagggaaaaaaatcgttttttgtattcaagcgataaatttttatcatttaaaatgtctgccaatttagaaatacaatatgcattatgaacttgcaatgaattaaaatctataggatagtacgcatctactcttggggagttcttataaaaaattttatttacatcaattgaataaagaccattttcctttaaaaatttgctctctatccatttataatacttatcaagaattggtaaaacttcagaaattctctttttatttcctgtcttatgatataagttgtattcagcccatgcaaaaataggaaatccaatattctcttcattctcatcaagatcaataatagcattgttattgtcatatctagccctgattgcaccagattcttcctgcaattgataaaatttatcaattgcagatgtagatgaatattccccattactatagacaagaaaaaagcttgacatacaagcttgcatctgatctatataatcacaattttccgaataataatttttatcttttttgcccctatcagcaactttttgcaaaatcaccttatcttgaatccaagataaacttttattataaatatcaataaagtcttgatcataatagtaaattttgggaaacatttttttattcaatgctaaatcctctaaaacaacagaaatgtacttctatttattataacacaataaatataacataattaaaaaattaaaaactggaaaattaaaatctttctatttcaaaagtttataactttaatatttgttttataaaaatttcatattcctcctgattgcaaggaacaatgatctctttattgattatttttctctcaagaacttttatgtattcaaattcattcgcattaggcagcccaataacaccatctcttaatcccatttgaacaacttttccaccttcccaaacattattatttttaatatattcgccagtaatcaaatacaatgcgtccccaatgttttttataacagaagtaataaaatttttaggagcaagatatgactgatcctgatcggctccaataacatagtaaccatcgccaaggttttttgctgtctcaataacaccaattcctgctaaaccagctgcaaaatgaattacatctatccctttagaatacattttactagctatggttctaccaatatcaacatcggaaaaagaattggaatattcacttataatctctatatctttattagcatactttgctccagattcataaccatagcgaaatgcatctactatattacccttcattccccctataaaacctattttgccagaaaagctttttttggctgcaatatagccagccaaaaaagcaccttgctctactctgaaaacaacagcaatcaagttttcaggaatctgaacatcatcaccataaatgggatctattattccatagctaatttttggattctccgatgaaaccaataaagatgcgtccgtaagcatgtaccctacaagccaaatcaagtctgagccattcctttttaaattatcaagatctgaaacataactagaataaactccagaaatagcacaagaaaaaacttcttcaatattttctggaaaatcttttttcaagcgtaataaagcctcattagcactagaattaaaagatttgtcgtcaagaacaccatctaccaacatggatatcttaattttttttgaactagattctattccatttctactaaagcaagaagtcaacaaaataccgaatataaaaattacaattctcatataaagcacttctccatttcaattattcaaacaaaaccaatgtgttttttatacttaaaaataaaatatataaattgattctttatttaaataaattctttaagaaacttctcataactttctttattagatggaacaataatttctttgttgattattttgctagaaagattgtcaatttctttttcaagttcaaaggaaatcattttaggatttcttacaaaccccacaactccttctttaaggccataatttattaatttgccaccttcgaaagtattagtttttaaatggttagatgtaaaaatatttaaagctctaccaacatctttagttgtagatgttattacattgtcaggagcaagatatgcttgatcttcatcaactccaataatgtaatgcccagaaccaagttcttttgcaacctcaatagccccaattcctccaaggcctgcagcatgatgaataatgtctatctcatcagaatacatcctagttgcaacgcttctaccagcttcaaggtcagcaaaactaccaatatactgagtagatatctttatatctttattagcatacttagcaccagcttcatacccatacctaaaagcatctactatctcgccttctattccccctaaaaatccaattttacctgttttagaaagttttgcagcaatataacccgttaaaaatgcaccctcttgagctctaaaggtcatgcccaccaaatttgcaggaataggatcgttagaataaataggatcaataattgcatatttcatatcgggattttgaagagccgcaaccttggccacatcgctaaatctatacccaataagccaaattaaatctgagcccgcatccttaagcccttcaagatcagataaataagaatttgatgaggattcttttaaaacaagctcaattttaaattcttctttaactttttttacgccatttaaagcactctcattaaaagatttatcatcaaaagttccatcaattattaaagataccttaggaatttcgctcccaagactacctttaccactacaagataaaaaaacaatactctcaagcaaaatcaacaacaatattttattcataaactatttcccctttacaaacaaagctatatttaagtagtttataactttgatttaaataaatcaaatgcatattcactatcaggaacaataatttctccacttattattttattttctagatcaataacttcatcaaccaacctattgtttaaaacatcgggatccttaacaatttctattactccttcctttaacccccgatcaataataattccacccttaaaaactctattattaatatactctgatgaaatagaataaataaccttaccaatatccttaattattgaagtaataacattttgaggcgcaatatatgattgatcttgatttaaaccaataacataatatttaggtccaagctccttagcagcgtcataaactccaagaccagttataccagctattggaaaaataacgcctactttatcttctttatacatgaatagagccattgctttgcctttctccttatcaaaaagagaaggtgctttttttgaaactaatcttaatttaggattggcataaaaaattccagccttaaaaccaaacttaaaatcttttacatgctcactcataggacctgttaaaaatccaatcttttcttttctgctcatcttagcagcaatatacccagctaaaaatgcagcctcttcatttctaaacttaatagccaaggaattcttaggaacttgaatatcaccataatcaaaagcatctataataccataataaatatctggacgttcataggaaagcttaactgacaagtcagaaaatcggtatccaatcaaccaaaaaagatttaaaggatttttttgaacctcataagcatcctcagtcattgcctcatcaacagtaagaagtcttttaccctcaataggataaggtcttaaagatttagttataagctttattccaaaattatccctaagttttacaacaccatcatgaacgctttgattatagcctttatcataaaagctaccatgagccaaaacacctacaacaactttgtcagatttaatagactttttattagatttaaaacaagcaaatactaataaagataaagtaataaaaataaatcttttaaacaaaattaatcctctccttatattttttttaaaaattctaaattttttaaaaattaaaatattaactttattttactaacaagtagtattctttatttataaaataaaattttaataatcccttttaaaaaaatacttctagcattaataaaaacacagtagtaggaaaaataatttttcctacatcaccataatatccaaatttaaacccttttgcaagattaatttaaattcaaattacaacaattaaaaaaccctttaaaacatctttaaagaattaaaaagatttttcacaaatcagctcaataaaaatcaaattaattttccatttgcaaaacaaagttatcataagataccttgtcataaggcacttttattataccattcattatactttgcccaattttcaatgatttgttataaatctcagaataatttgattttaagttttcatttaaaactaaaccaagaccatcttctttaagccctaaaaacatggtcttgccaccatccaaaactccagtttctaaatacttttttgttaaactatacatcaatgaatcaactttttttacagcagaaacaataacattgttaggagcaagatatgattgatcctgatcgactccaataatataatgatcgggccccaactcttttgcggcctcaattacccctataccagaaagccctgcagctgcaaatatgatatcaaccccatctcgatacatattagatgccgttgaacgaccaagtccaaagtctccaaatgtaccaacgtattgagagaccactttaatattagagtttgcatacttagcaccagcttcatatccatacataaaagattctaaaacttttcccctcactcctccaacaaatccaatcttacccgttttagaagccttcgacgcaaagtatcctgctaaaaaagccacctcttcggatctaaaactaatattaagaagatttttgggtatttgaatttcatcataaaccccttctatgattgcataattaacagaaacattctcgctagctctttgaaaaagaatgtctgacaatctaaacccaattccccaaatcaaatttgaattaccatcttctaagtttgcaatatctcctaaataagaattgcctgtagatgctttttcaattatatttatatttaaatctgcctttaattttcttatcgccttagaagaactttcattaaatcctttatcatcaaaagcaccatcaactataagcgaaactgtttttgcctccgacttgccatcatcagagctagaacaagcaacaataaataaaaaaattaaaaaataataaactttttttaacataaaaatatcctccttgcttttaataaaaaaatacaaaaaatagatctcataatacacggcatataaacaaaaaaagacaccttaaaaaggtgtctttttaccatctataatgagtaaaagctttatttgcttcagccattctatgagtatcttctttcttcttgaaagcagctccagtagaattatatgcatttaaaagttcgtttgacaacttttctttcatagacctaccgctagactttctagcagcaaaaataatccacttcatagccaaggcttctcttctctcttctctaacttcaacaggaacttgatatgtagcaccacccactcgtctacttcttacttctaccaatggcttaatattatctaaagctttataaaaaacagccatcttgtcgctttcttcaagcttatcggcaagcaaatcaattgaactataaagtatactctcgcttattgatttttttccatcatacatcattctatttgcaaactttgcaacaattctagaattatatctggtatcaacaaaaactttctttttgatttttttattttttcttgacatatttaatattaacccacctttcagttaagctttaggcttttttgttccatacttagatctaccctttttcctattattaacgccaagggtatccttagctcctctaacaatatggtaccttactccaggcaaatctttaactcgaccacctctaattagaaccacagagtgttcttgtaaattgtgtccaattcctggaatatatgctgttacttcaaatccatttgaaagtctaacacgcgctacttttcttaaagctgaattaggctttttgggagttacggtcattacacgcgtacaaattcctcttctttgaggacaattttgaagcgcaggagatgcggtcttctccgtttgactttttctaggctttctaattaactgattaattgtaggcatttatcaacgctctccttttcttgaaactattaataaaatggtagcaaatatatcacttattttcaagttaaacttcagaatcgatattttcactaactttaatttttttataaagacccataccagttccagtaggaattaaatgtccaattacaacattttcttttaatcccctaagatcatctatttttccagcaatagaagcatctgttaatacttttgttgtttcctggaaagaagctgcggaaataaaagaatctatattaagagacgttttagttactcctataagaattggacttgctattgctggctcaccaccttgttcgattacttttctattttgctcataaaaagtgtgcttatctaccttttgcccataaacaaaattagtatcaccaactgcaacaatcttaacttttttcatcatttgcttgattatcacaccaatatgtttgtcattaatgctaacaccctgttttcgataaacatcctgaatttctgccaacagaaattcttgtaaactaatcccacctaaaatttcaagcacatcatgaggattaattctaccatcacaaagcatatctcctgcttttacaacatctccatctctaaccaaaagatgttttccagctggaatataatgcttatgttcaaccccatactcatctaaaatattaataagccttttacctttttgaattgatttaaattgtacaattccgcttactttagccatttcagttaaattcttaggaattcttgtctcaaaaagatcattaacacgaggcaatccccctgtaatatcttgagttttttcagaacctttagaaagtttcgcaataatatctcctatgttaatactctggccatcttcaacttgaagataagcatcacctggtaatacataagatgcaacctccataccactactatcaataataaaaattctaggatcaagagattcaaaaacattatctgtaattcttttttcaacattgcctgtttcagtatttatttcctctttaagagtagttcctaaaataatatccttaaatttaattttacccttaacctctgcaataataggctctgcaaatggatcaaatgtaccaataactttgcctgattcaacataatcaccaacctctatttcaagctttgtacccgctttcaaggaaacttcttgctcttctgacactatgaaaaaattatcgtctcttaatttaacataaccaatgtaagaagagagaatctctgagccctttttatcaataaacaaaggaattccttttattactctttgagaatctaaaactttaatctcttttatgttcttaattttttcctcataaaaaacattgattatttttaaagttccttttcttgtgaaaagaattccattatcaactctaacattaaaaccttctatgccattaagtatgaaggcattctttaaagatattttatcatcctcactgccagcctgagcaactccaccaatatgaaaagttctcatggttaattgagtacccggttgacctatggactgagcagcaattattcccacagcctccccaatattaacaggtttgttcttagaaaagtctctaccataacatttttgacaaacgccatgctcagcttcacacgttaaaacagatctaataacaagtttttcaataccaattttctctaataattctattttagcttctgagatttcttcatttgcatctaaaacaatctcgccagtaattggattttttattctttcaatagaataactcccaacagctttttctttcaaagattctaatatttcttcaccattttttacagtctcaacttttattccatttatagttccacaatcctctattctaacaacaacatcttgagcaatgtctactaatcttcgagttaaatatccagcatcagcggtcttaagagcagtatctgctagaccttttcttgctccatttgtagatataaaaaactctatcacagaaagaccttctttaaagttagaaataattggaagctcaataatatccccagaagtttttgccatcaatcctctcataccagcaagctgtcttatttgattcctactacccctagcaccagaatctgccatcatatatataacattaaatccatctctatctttctttaaaatttccatcatcttattagtaagttcttcattggtctttaaccaaacagaaactacattgttataacgctcttcgccagtaataacacctttagcataatcattttgaatcttagcaatctctttattggccctttctacataagttcttttttcatcaggaacaataatatcgctcatactaattgtgcatccaaacttagtggcatacctaaaaccaagttccttgatgatgtcaagcatttcaattacgatagaagaaccatgaactacataaacttttgatattaaaatttgtagctccaaatcactaagggttttatttacaaattcaattcccttgggcaaagcctcattaaatataaccctaccggccgtagtttttttgtactcaccatgaatttttacataaatagaagcattgtaatccagactcctattatttatggcaagaataacattgttaaagtttaaaaactttttaccttctccaacaacattctttttttccatagttaaataatataggcccaaaacaatatcttgggatggaaaaacaataggatgcccattggcaggatttaaaagattatttgttgaaagcattaaagcccaactttcagcttgtgctgccggagtaagaggcacatgtaccgccatttgatcaccatcaaaatcggcattgtatgcatgacaaacaagaggatgtaattttattgccttaccctcaactaacacaggttcaaaagcttgaattccaagtctatgaagagtgggtgccctatttaaaagaataggatgctctttgataacaagatctaaaatttgccacacctcatctacttcttgctctattaaattctttgctcttttgatattaaaaacagcttcactctcaatcagtcttcttatcacaaaaggcttaaaaagctcaagggccatttttgcaggcaatccacattgatgtagcttaagctcaggtccaacaacaataacagaacgaccagaataatctactcttttaccaagaagattttgcctaaaccttccctgcttaccttttaatgcatcggaaagcgacttgagaggcctactagatgaacctttgacaacctttcttttatgagaattgtcaaaaagagagtctactgattcttgaagcattcttttttcgtttctcacaataatctctggcgcattaagaagaagcaactttcttaaacgattatttctatttatgactcttctataaagatcattaagatcagatgttgcaaagcgccccccatcaagctgaaccattggcctaatctctgggggaataacaggaagaacttccataatcatccactctggcttattgccagaaattttaaaattctcaataatttcaagacgtcttaagagtttcttatcagttttatcatctttatctatcatttgaattctaagcttagacgaaagctcatcaagatcaagattttcaagaagagttttaatagcctcagcccccattgaagcattaaaagacataccatatcgctctctagcttctatgtactcatcttcatttaaaagctgcatttttttaagatcagtatcgcccggttcaattactacatatttttcataataaagaatagaattcaaactagatgctgtaatatcaagcaaaagcccaatcctagagggtatatatttgtaataccaaatatgagcaactggggctgctagctcaatatgccccattctttcacgtctaaccttaaaatgggtaacctctacattacaacgatcacaaataatacctttatatctgaccgatttaaatttaccacaataacattcccattcctttgtagtaccaaaaatcctttcacaaaaaagcccatctttttcgggtcttaaagttctataattaatagtttcggactttttaacctctccataagaccaatttctaatttgatcgggagacgctattttaatttttattctttcaaaatcttttatctctttcataaaaactccaaaaacctagcttttattaatcaattcttcttctttttctgtcaaaggaacctgattcccagcatcatcataaattgacaaatcaagtccaagccctctaagctcttgcattagcacattaaaagactcaggaatccctgatacattagtaggaacgccttttactatattttcatatattttaactctgcctgacatatcatcagatttaactgttaaaagttcttgaagggtgtgcgccgcaccataagcttcaagagcccaaacctccatttctccaagtctttgcccaccaaattgagcctttcctccaagaggttgctgagaaacaagagaatatgggcctgttgatcttgcgtgcattttatcatcaacaagatggtgtagtttaagcatgtaaatcaccccaaccattacttcattttcgaacggctctcctgtataaccatcatataaaatttctttagaagttggattaaatccagcagtttttaatttttcctgaatttgttcatttgtagcagattcaaaaacaggaacattataagattcaccaagatatttaccagcaaggcctaattgagattccattaactgtccgatattcattctagatggaactcccaaaggatttaagcatatatcaagaggggttccgtctgcaagataaggcatatcttcaacaggaagaatctttgcaacaacacccttattaccatgtcgtccagccattttatcgccctctttaagcttcctttttttggcaacataaactttaagtatctcctcaactccaggagaaagattaccaacatcctctttggtaatcctttgaacatcaataactgtaccttcagtaccatgaggaacttttaatgaattatttttaacatcttttgctttttctccaaaaatggaagttaacagtctaaattcaggagtaatgtctccttctgactttggagtaactttaccaaccagaatatcaccgggctttacataagttcctatccgtataatcccattttcatccaatttatttaatatcttttcactaacattaggtatatctcctgtaactttctcaggaccaagtttagtttctcttacctctatgctaaattctttgatatgaatagatgtataaagatcttcctttacaattctatcagaaattaatatagcatcctcataattaaatccattccaaggaataactcctagcaataaattattaccaagagcaagttctccatatctagtagcaggaccgtcagctattatctcgcccctttcaactttttgaccctctttaactaaaacggattgattaaaacaagtgtcttgatttgtcctttcatacttaacaatatgatattcatctaaatctttagcattctctgcctcaaaaggtttaacaactatcttactacttgttgcaagaataacttccccacttcttttagccttaacaactactcctgaatcctttgcaacaacgctttccatacccgtaccaacaataggaggcttagggaaaagcaaaggtactgcttgtctttgcatattagaacccataagagctcgatttgcatcattgtgctcaagaaaaggaattaacgccgaagatactgaaattagctgcctaggagaaacgtccatatagtctatatttgtgggacttgttgtagtataatcaccagaaattctaacagaaactaaatcttcaagatactttccattagaattaaaagcagcattagcctgagcaatacactttttctcttcgtcaatagcagataaatattctaattggtccgtcaccactccattaacaactttcctataaggagtttctaaaaaaccataatcattaactctagaataagtagccaaagaaacaataagtccaatatttggcccttcaggggtttcaataggacacattctaccataatgagtataatgcacatctcttacttcaaatcctgccctatctcttgaaagtcctcctggtccaagagcattaagacgccttttgtgagtaagctcagccaaaggattgacctgatccataaactgtgaaagctgactggttgcaaaaaattctttaacagcagatacaataggcttaacgcttattaattcttgaggctttagattaaaaacttccttgttagacattctatctttagcaattttttcaactcttgacatcgcgcctttatatatattagtaagaagctcaccaacagaacgaacccttctatttcctaaatggtcaatatcatcaagaatatcatggccttcatatattcttaaaagatgagatatggtgttaacaatatcatccatagttaaaaccgatgtagttaaatcatcaaatccaaattttttagaaagtttataccgccccacacgtccaagatcatatcttctttcagaaaagaatatggtttttaaatcgttttcagcattatcaattgatattggctcaccgggaaaaagagaaccataaacagctagcataactgattcttttggaagctctttagagccatcctttaaagcaaagaaagcatcctctttttcaagacaatttagaataacattcgaacttacaaagcgctttccagaaatatcattataaccatcaaaatcaacaagctctatttcatttactccattttgtaaaaaatcttcaacatcttgcagagtaattttatctcctgcacgataatacatattctctcttatgttaatactcttagctaaatattgccctggaagatctctttttgtaccgtcttcaactttaatttttttaatattgtaaaaagtttctattattttttctctcgtatcaaaccctaaagctcttaaaaaaagagttataagtattcttttttttctatctatttttacataaagataatctttttttgaatcaatctcaaattctaaccaagaaccacgataaggaattattctagcagaatacaaatctttttctttataaaaaacaactcctggggatctgtgaatctgagaaacaacaaccctctcagccccattaataataaaagtgcctctttctgtcattaaaggaatagttcccatgtatacgtctttttgccttatttccccagtagtcaaaaattgcaaattcaatcttacttttaaaacagcctcataactttgaccctttcttttacattctttttctgtaaaattaagggcatcgttttctatatagtatctttcatactcaagagcaacatcaccatttccacttttaatgggaaatatatttctaaaaacagactcaaggccctcattaagtaaaggttttttactttttaatttatcaagttgtaaaaatttttcataagaatttaattgtatttctatcaggttaggtaggtctaaaatctcatcagctcttccttgtcccagatgaactctttttatcattaaaagactccttttttaagacataacaagccgcacatcataacgacatgcggaataacaactttgatatatttttaattttttatttaacttcaacttttgcgccaactgcctcaagtttcttttttaattcttcagcatctgacttagaaagaccttctttaatagctttaggagcggcttcaactaacgccttagcttctccaagaccaagtcctgtaatagctctaacttcttttataacatttatcttgctatcaccaaaagacataagaattacatcaaattcggtttgttcttcagaatcagccgaacctactgaaacagctccccctacaccagcagcaacagcggcagttactccaaacttttcctcaatagctgttacaaggtcaacaacttccatagtttttgcaccttcaagccaggttaaaatatcttctttatttagtgccatattaactccttatatattttcatttcacagtgatagcatgcactcaaaaattaagactaacactgtcatgttaatttttaacatcagccaaagctttcaatgttcttgcaagcttagaaactggcgcttttaacacgctagcaaataaagaaatagactcttttttggtaggaagcttgctgtaagcttgaaccttagcctcatcataaaactctcctaatacaaaaccgccctttacttttaaagtactactttttacaaaatcataaaaaatttttgctattacattagcttcttctaatgcagtaacaacaactgtagggccaaccaaacaagaatcaacaacattaatattcttttcttttaaaaccatcttcattatattgtttttaacaacttttaatgatccatgttcgccttctattttattgcgaagttctgttaactgagctacatttaaacctctataatctaagaaaaaaagattttgtttgctatctataaactgttttaataaatcaaacatttccaactttttagcatttatctttgcgctcataatgttacctccaaacaaaattaacttttatagaaggccccatagtagatgaaatataaatactatctataaaagctccctttaagtcactcggtctttttttaacaacttccttgacaaattcctcataattttcttttatcttttcattgtccatagaagatttaccaaaagaaaagcttattacaccatttttatttgccctaaattctgttcgaccctttttaagactgttgattgcatctttaagattatttgtgactgtttgagtctttggattgggcattaaaccccttttccctaaaataggaccaagtcttccaacatctttcatcatatcaggagttgcaacaacaacatcaaattcatcccaaccgcttttaatcttatttataagatcatcatcgccaacataagttgcaccaaaagctctagcttcatctgctcgatcaccttttgcaaaaacaagtattctttttggcttcataaactgatttggcaaaactatagtgtctctaacagtatgatttttttttaaattaaggttaatagatatatctatagtttcatcaaatttggcaaatttaatttctttcaacagcaaaattgcatcttcaatgttataaaatttattcttatccactttagaaaaagcttcaatatattttttacccttttttgacattatttctccacctcaacacccattgaacgtgcacttcctgcaataattttaaacgctgctgattctgactttgcatttaaatcagacattttaattcttgctatctccatcaacttttcttttgatatggttccaactttatctgtattagatttcttagatcctgattctatcccaatagcttttttaattaaaatcgaagctgggggagtctttacaataaaagaaaaacttttatcactataaacagtaataataacaggaaccacaatgccgggatccatctttgcggttctctcattaaattcctttacaaactgaggaccactaactccatgaggtccaagcgcttgccctattttagctcctggagccgcttgagcagctggaacctgcaatttaatccaagaaattgcttttttttttgccatataatctccttatggtagtaacgccttcaaagctcccattagtattaaattttaaatcttttctatatgttggaaatcaacttcaacaggcgttgatcttccaaaaatttgaactgcaacttttaatttctttctttcataatcaatagaactaataagtccttcaaaggagtcaaaaggtccgcctttaattctaactctttctccttcttcaaagtcataaagcataaaaatagatttatttgctttaatctcaccagtaagcataaaaacactttttacttcttcatcattaataggaataggcctttgccccttactaacaccaacaaaattaataacgccttgaactttgataatattagcaataatatctttccagcctacttctggaagatctagctcaataagaatatagcctggccaaatttttctctcccttattcttttcttgccatttcttatctcttctactttttcaataggagccttaacatctaataccacaccgccaaaaacaccttcatttattaaaagccttatgtcctgctctatctttttctcatattgagaataagtttgaactacataccaagctctagacataatttacccttcttataataaaactaaaatacataagttacaacaagaaacataagataatcgactatacccaagaaaattgaaacaaataataccagccaaaaaacttgctttccatttccaacaacttcattatacttaggccacgttaccttcttaagctctaagatactatctttgataaacctaaacactttaaagcctcactttaattctaacaacaggtcaggagggattcgaacccccagcatacagttttggagactgtcgttctaccgttggaactactgacctattatttattattttatttttccttctttatgaagagtgtgttttcgtaattttggacaatatttcatcaattctaacttttcttgcttattgcgtctattcttagtagtggtataatttctaattcctgtttcttcacaaatcaaagatataagctcaacagctcctttgcccttctttttacccatataacaaaactcctaactaccaataaaagccctcaatcggacttgaaccgacgacccccaccttaccatggtggtgctctaccaactgagctataagggcactaattccctataaaactctttattatcttagttgattgtttagaaaaaaacaagtactaaatttaattttcttactttattacaacaagttttccatcttgcagaagtttaatgttgttactatttgaaaacaacttattaatagaatactcatcaagtataatatctgtattatttttaccataaatacttttggcaaccaattttaaaggacgatgtccaaccctatttttattattataaagaacatcgttgctatactcaagcattccccattttttcaaagcctctgaagaaaccattctcttatcaaaatatggcctaatgttttcatcataaattttgataaaaaaagagtcttctaattttttagaaccagaagtattattgtagacttcgcctacataaatcacaattcctgtataatcggttttatcaacatcagaatttactaatggataaaaagctttataaggagtttcatgtgaaaaaaataaatttataaaatcggggaaaagactaagctcatacctaacagtaagacttcttaaatcttctgaatattttatataagaccttttcaaaatactattaggacctgaaaaattaagtatcaagctgggattcaggtcaaaataattcttaaaagtattttcagaatccataattatcttaaaaagagattctcttattaacgtgtctttaaaatcattaatggttgctattaatttagacgctgtatttaaacccactggtctaaattcattttcattaatttccttaacaatgtcaaaacaaataaccttcctatcccaatcgattattctgtgcacacttgtctcagcagcttcatcctttattatggaaacattagaataaagtagaaataaataactaaaaagaaacttaagaaaatgcattatctccttcctattattttttacctaaatacacgcctatccaagtccagccattattaatttctggatctttaggataaacaattcttttaaaaacaaaataccattcatgaatatggtcccagccccttgactcaagataagatatatcgtcactagaatctgcctcaagatgctttgcaaattgtattccgttttttcttctccccccaagcctaatcatagtggttaaaaagctattagtattaatggaattactctttccacccttttgatcccagctttgaataaaaaaattattcttatctcttatattaagcaatttagaagtattaccagaaagaacaaaatttttaacatcctggattaaatctcctaaatttctataaacaacaaactctggattattaaagtaattaatttttgtaacaacattaaaatagtctctagaatctatttttaaatgtgcccttggaattgaaagaaattttttataataaaaataagattcatcgtaatcttgaacatcttccaaacttagcgcaagattataaaaataattacccttttcctcattatttaaattatcaatccccatatttaatataaatttgtaataattgattttatcgattgaatcaatatttaaattgacaatctttttagcaacccttgttttcattgaatggttttcataaacataatcatcaaaattatcaacaacacgcttgtaaatattaaaagctacaaaatcttctcccatggaatcataaatattgcccattaaataaagatacaaaggataatattctctagattcatcatcaataattccattatttacaatttctaaagcatcttcataatttttatttgcaatatatatgttaacaactctatcaataataagaaatttatctaatctatttttattagaagattttaaaagatgtgtaagattttgaatctcgctttgcttttggttgcaagaagtaaataaaaacaaaatcaaaataaatttagcaattttgaccaatagattcataagagtattttacaatataaactacacataataaaatgcacacctcaatttaaaaagttgtcaaaatttttataaatactaacttaacatcaccacattttacattaacaccaatgtaaaaatattaaaacaacaaaactaaagcctaaatttaaaatttagcataaaactccaatataaaaaaatagtaaaaatcatttcataactgacaattatgaccacaaaaacgttgaaaaataatcttataatgacctataataaatgttaatttaatacctatttaaaaagcaatcgtctaaaattaaacactttattaaaggaatacaaaactcacaaaacatgaaaaaagaattcattatgcttttactgttattgcaaacaataatgaatttaaactcaataaatactaatacaagtacttcaatagtaaaagaattgcaaaaaaatttatatattttcaatagcaaagaatatcaaaaagataaagacactttaaatgaatttataaattcaataaatataaatgacaaagaaatcttacaaagtttagaaaaaatcaaaaatgagctttttataatatctgtttttttcaacaataaaaaagggattttaattgcactaaatcttggagcagaaataaactttaaatataaaatatctccaatttcaatttcaataataaacaatgaatttgaaatcacaaaaatattgatagattacggaataagccttaatcaaatagatgatacaggttattctccaatattttgggcaatatatactaataacgaaaaaatatttgaatttttaaaagaaagcggagctgatttaagtttcacacttaaaaatagaaaaacaccaatgcaagccgcaatagaaacagaaaatataaaactaattaaatctctggaaaagaaaaaaatttacattgacgacaatttcaaaaaaaaacttaaaaagcttaaaaacaaagaaatagttcgaattttagtaaaatagaaaataaattcaatacccatcagatgcttggatatttttatctttatcaataagatccttgtatataaaagattttttagcaagcgtctcttttaaatttttagaaaagggtaaattcctccacattattccgcgtactaatttctcaagtttttgaattcctttactttctttttctatccaaagaaaataatcttctaaaaaaaattttttaacatttccctttttaataaatttaacataataatcgtaatattggcctgtaattcctgtttccatccacctaaaagaagcttgctcttttgcaagttcccaaacaaaatcaccaatacccaaaataaccgcctttcttaagtttttagcatacataggtattaatattttacccctaccatttgctctgtttttaacatcaattgattcccaacaaattcctttatcaccataagaaggtattaatataaaataaggaactactctgagcaaatctcctctatacgctttttgaaaaagtctaggctgaatatcttcgatttcccaaacaagctgcataattctttctctacttccaaaaaattgagggttagcaactacattatttttcaaaagaataggaaaatgattgcctcttggccctatcgcaagtttattggcgcttctgataacttcaacttcatcatgtgcaatagttgattcagtagacatcccaatattattcattttattttgaatttcaaaaagctctctgttagtatcttcaattttattaataaaaacattaatatcccgatttgatttaataagatcatcaacataattactagcaaaatttaaaggctttaaaatcgaattaggataagaactctgcactccgtattcagtcatataagttaaatcgctttgactattatttgaaaataaaaattcaaacatgcttcttaacttactaagagcctcttttctgatcttatcagttctcttaaggctactttttgcaaaatcaatatttgccaaaagtttttctttcttattaagtaaaactttttccatatcttcttctttaaaattatccgttggcaaatcggttgctaatctactaagcttaaaattattaaccccataaagccattcatcaaaataaataaaagactcattataatgattgtcccaaatagtttttgaaattaatagctgaatttcagatccaagtgcatttggaataagtgcggcaaatctaaataaaattttctgctccatggtcaattttgaaatgttttttgcaattgatctgagaaaagaccaataaatgttaatcacttgattatattttaaaaccctatcaacctcttctgactgcggatttaaataatctaccaaaactttatgaagcttaaagccaatttctttactgcttgaaataagatttttataaaaatctttagtaaaaaattgcttatcatgctcctctaaagttaaaatatttggcaatctcgaatttaaatctgtatctacagaatcaggatacttatacaaactacccccaaaaacacccacaagcaatatagcgacacaagtacaattgtaactctaaagtttatatttacaaaaaaatttagtactatttattatacacagtgtaccttaaatctctgaaaggagaagtcatatgaatataaaaatcaatttttttttcactttgcctattggaatctttttaggattgtttttccctcttggaatttatagctccttatcacatgcttttataagattatcatacttatctcttattccctttttaatattttcaattccattaggaattgaaaatattattgaaaataaaaactttaaaaagctttttggtaaaacaatttattatggaattttaactaacctatctggagttgctgtatcaataatagctgcaacaatatatcttccgcaaagaattccaatactagaaaaaacaatacaaaatacatgtttttttgaaaaagaagctttactagaaacattctttccaaaaaatattttcaaaatatttacatctagcaatccaaatctactaagcatttacatgatttcaataataataggcacaagtttttattatgcaaaacaaaaaggcagaatagctagagaactgatgctaagcgcatccaatcttttttaccatgcaaatgggtttattgtaaacatattaaatatagggatcatttttataacagcaaattacgctgcaaacttaaaaaacttcaaagattacccaaattatacaaacagcataacattctttttggcatggacaattataattttattcgtaatattgccaacaattagttatagattaacaaaaagttttaaaatgatatataaaggcatttttgtatcatttcaaaacataatattttcaggacttgcaaaagattcttattccccttatgtgatattaatagaagatattaaaaacgaaagaataaatataaaaaaatccataattataaacatacctttaataaattttgtatctaaatttggcactatttttgtttcagtaatatcattttttataattttaaaatcatattctagcttacccatttctatttatgaaataagctatatgagcactttatcatttgtttttgtctttgcatttcctcatataccaaatagtttaatttatataattacaatgctttgctctacatatacaaaaggaatagagctaaatgtttcaaacataacaccaatgctgccgatattaatctctttggctttactaatcgactttgcttttaacattgcaatcattcatataataaacttcaaagaattaaaagatcaagaaaaaattaattaaagctaaacaaattaataggatttggcaaataaaacaaaatatttagctttagatgaacaataaatacaagtcatgcctgttaaatctctggccttaaaatcatcggggatacatcttattgtggctttagtttcatttttaataatattttcacaattcaaactgccacaccaacaagaaagcacaaatccagaataatcattcacataggctttgaatgtctcataactatccttactgcttctaaaaatctccttagtattcaagatcctaaaatttaatgctctttgaaataaatctttttgcatcaaatcaagctctaccttaaccttgcttataagagaatcaagtgatatttgatacttaaattttctgtctttatctcttcttgaaatagtaacggaatttaaaaggacatcatttatccccacttcaaggcgtattggaattcctttaaactcggcagatgaaaatctaaatcccggagaacttctaacgtccttatcaatttcaaccctaaattctgctttttttaaagcatccacaacacaatcagaataatctaaaatttttttattaatctcatcttcttttttaaaaataggaataacaataatttctattggagcaatgcgaggcggcaaaactaaacctttctcatcagaatgaaccataatcaaagcaccaatcaatctggtagaaacaccccagctactagcaaatacatgccgcatcttgccatctttgtcttgaaattttacatcaaatgcctttgcaaaatttaaacctaaataatgggatgtagcggcttgaagcgcttttttatcttgcattaatgcctcaattgaataagtagaaacagcccccgcaaatttttccttttcagattttttaccacaaaacaccggaatggccaaatagtcttctatgaatcttttatatacatctaaaataagtaaagtttcttctaatgcctcctcttcggtagcatgagcagtatgtccttcttgccatagaaattcggtagtgcgcaaaaaaggccttgttctcttttcccaacgaacaacatttgcccattgattaattttaagaggaagatctctgtaagacttaatccacttactatacatattccaaataattgtctcagaggtaggccttaaaaccaaaggctctgccaaactctctccaccagcatccttaataatagcaaactcgggtgaaaatccatcaatatgatccttttctctttctaaaaaactataaggaataagcatagggaaatatgcattctcgtgtcccgtctctttaaattttttatcaagtatactctgaattttactccaaatagaatacccataaggcataattaccatacatccttttacaggactgtaatcagcaagttttgctttctggactatatctaaataccatttagaataatcatcttcttttgatgctataaaatcactcataaattatcctcaataaagcatttcacttctttaaaaaactaaataattatattcaatattttttaacttcaaccataaaccgtttatacctatttccataagaatttaacatgattttttccaaaacaaaaacaattccatcttcatttggaaataaaacaatctctcttattctgtaatcaataacattctttctataataatttcctcttccaacagtcaaatgcttttctagagttgaattacaatatctgacagataaaaaaatattaaaagaagaagaaagttcttgggaattaatatccttatttacaaaaacttgatattcgtttcctgttttaaaatcaacaaaatttaaaaaatctgtttctggaatttcactttttacataaaaataaatttcacgccctcttcttaaatgattaattttaaattctttaactttaaaattaatcatctttaaaagctcataaagacttttatcataactgtctgaatacccaatgtgctctttaaaagtcttagaatgtactccagagtttgcaaaattatttttaacaacatcaacaaagtatgcagcagagtaataatatccattttcaaaaccatattcgccaaacataaaataccgatcattattagaaaatcctaaatttttaaaaaaaatattttctggaaaccccaacagaaaagaaaaaaaataaaaaaaaacgatatatagtttaatcataagctttgtataagtttaataacaataaattatctactaaatcttatttataattaatttagccttacttaaaataatatcaaaacagcatttcaaattcaaaactttgatatactatttgtttatagattaaaaacttaatatttaaatttttgggataaatttttgaaaaaaagaattaatggcctaaagttagcttcaaaaagcttgaggcaaataaagtttttttgccatagttttataataaaacattgcaaaaaaacttatttattgcaaattcataaatttatatttttttcaaaggccaaaaaatcaaaacaaaaatatcttcccaaaaatcctttacaaacaaacaagattaacatcaatatacagtcaagtagtataataatagctgtatttgtgattaaaaattttttgataaccaaaaccttgataaacaaagcgataaaaaattcaacaataaagttttgctatcaaaataagcaaataaatatcaatatttttaattttttatgctttattaaaaatattgtaaaaataatttctaaaattgaaaataaaaaaggagaatttcaatgagaatgctattagcaacaataatacttatattaacaacgggtttattagctgcacaatccaaaagcaaaagtatgactgaagatgactttgattttgataaacttcttgcaaaagaagagtctgtgcgccgtttatttggcataggttttggagttggatatccacttgcaaacattacaatatctgttccatatgtagacatagaccttgggtacggaggattcgtagggcttaaacccaacaatttcttgccctatgttgtgatgggtgtagatcttctatttaaagatgaaatacacaaaaacactatgatttctggaggcattggaataggtgcagattggtcaaaaggaagtcctgaaaaatcaaatgaaaaacttgaagaagaggaagaaaatgaagcacaacaagtagcttctcttcaaaatagaataggggttgtgataagattgcctttggtaatagagtacagctttcttaaaaatattgtgattggatttaaagctgttgctactattggaacaactatgctacttggcagcccaatgtcatttgaaggagctagatttaatttcttaggcacaggctttataaaaatatatatatagtggagaataaatgataaaaatttttaaaaaaatatacattttaacattagtattaggtatggcacacctttcttttgcatctgacaattatatggtcagatgcagcaaggaagaagattcaaccacctgtatcgcaaagcttaaagaaataaaagaaaagaaaaattatgacttattttcaatgggcattggaataggagatcctattgcaaatattatgattacaattccttatataaatattgattttggatatggaggttttattggccttaagtcaaacaattttgaaaattatctaaatggtggaatagacgttatttttaaaaagcaaattggacaatatatgaaaattggcggcggcattggaataggtgcggattggtcaaaaacatcccttataccccctaatgaagaagaagaaactgattatgagagaataggcgctgttataagaattccttttataatggaatataattttgcaaaaaatttatccataggattcaaaatttatcctgcagtagggccaacaatattactaacaaaaccaagcattttatttgaaggaattaaattcaatttttttggatttggattcataaaatttgcatttaattaaccaaataattaaattggtaattaaaattaagctcgcataagcaagcttaattttaattaaaaccagcaataaaagcttcgccgtccccatcaataaacaagttttctgcttttttacctataaatatgctctcacctttcttaagatttaaggatttatttatactcacgcacccatttaaaactagcaagaccattgcactatttctattaatacaaatgttctcatttatttttttttgaatcaatttcaaattagtatttggaagtctaaatacgctaaaattatcttgaaaatcgggatttaaaaatgataactttccttcctcaaattgaccaactcttaacatctcgtctttatcaatatactttgtagtaagcccagccctaataacattgtcggaattggtcataagctcaatgcaatctcccttaagatatgcatgcacctcctgactatttgtataaacaacttctcctggttttagttttaaaatattcatacctaaaaataccaaaaggcccacatctataccataaatattgtaaatttcattaaaccaatagcccctaaaattatcaataagatccaaattttttaaaattttttcaataatcttctcaagttcatacatttgtaaatcaaaaatagtctttacaaaatctttatgtgattgaaagtcgaaatttaattccagaatttcataaatttttttaatctcatctaagggtaaaaagcctttaagagcataaaaatcactaagagcataaataagttcaattttggggtttttgtctttgtatgtccttttgggatcattaatgtctatccctttattattctctgattcatacccttttaaggcaatatctttagaaggatgaatttgaatagacaggggcttatttgcagacaataccttaagcaaaaaaggaaattcgtcattacagcctaaaagctctttatgatcttctaaaaaatcgcttaaaagcacatattcatttttatacaaaatcttactagaaaatgtcttgtgtgctccaagccacatttcagccttgggctttccatcaatcttatcacccaaaagattgggaataaaattaattccgccccaatcatattctttaatattatttttcattaaaaaaatattatcttcattattcattcagattcctttaattttaaagatttcaaaaaaattaccaaagctgttgcaaccgcaactccaacagcaattgcaataataaacccaaatttattatcaataacaggaagtactattggtcctccgtgtggagcatgattagcaacgcctaaaaaagcggcaataatgcttgatacagctccccctaccactatcgaagggattacccgtccgggatcactagcagcaaaaggaatagctccttcgctaataccaataaatgaaattaaaaaggctattttaccagattctttttcttcattttcaaacaatttaggtgctaaaaaggttgcaagccccatagccataggaggaacaggaattgctgctgctaccattcccattatttctggcacttgaggaattagccctacaccaaaaagaaatgccactttattaaaaggtccgcccatatcaacagtaatcattgaacctagtactaagcctaagaaaattttacccaacacgccaaaagtttccgaattactctgtaaagatttaagcccactctcaagcacccccataaattttccaatataaacaccaaaatacagcataaaaaagccgacaataatggtgcttattagcggaattacaaatataggcattacaggtcttaaccactcaggaacagatcttcttgctaaaaaccttgcaacataacctgcaagaaagcccgcaaatattgcgcccaagaaacctgcttttacattcccagacattactccaccaacaagaccgggggtaagaccaggcttatcagcaattgccattgcaataaaaccagcaagcacgggcaacatcatcccaaaagctatagaaccaatatctgcaatctgcttataaaatggatgctcagcaaaattaggcccatcaggtccaatcccaacaaaagcaatgctaagagcaattaaaattcctccacttgcaacaacaggaatcattggagataccccactcattaaatatttataaaaactacctttgcctgttgcaaccgaagctttagtatcactattagtaccggagtctttgcttttaaataccggagcattaaaagattccttaataatattttctgtattgtttatcgcttttacagttgaaactttataaactctcttaccttcaaatctcttttcatcaatatccttatcaacagcaagtattacaacggacgcattcttaatttcctcttctgttaaggcattttcaataccaatagatccttgagtttctactctaatgctataaccctgctttttagcttcattttcaattttcttagctgcaatatacgtatgagcaactccaacaggacaagcagttacggccactattttttctgcttttgtagctccaaaaacctcttctttagcctttctttgaacattttcaatataataataaatgtcatcagtagtaacaaacccgcgtaaagcattttgaaaagcatcatcttcaaatagtttagctataaaagcaatcgccttaaggtgttcattaccttgttgtttttttgacatacaaatcaaaaatattaaattaacaggggggttttcttcagaccacttaaccccagaacctttaatgtaaagcaatgaaataaaactagtcttaacaacatctcctataaaatgaggaattgcaaccccattttcccaagaagtgtcacctatcttttctctatcaagaattccttgaagaaactcttttttattatctatatatcccttatcattgattttttcaattaaaaaatcaattacatcttcttttgaatttacttctggcaaaacaaatacaagatcttttttcaaaaaattaaaaaacataactgtggtctcctagtaattaaacatattgtataatatacaataaaaatagcataccacagccacctaatataaaaaatattttttaaactaaacagggaaattttatctaaatacatatcgcaatattgaaaaggtaaaacaatttttatattatttaaaataatcagtttatgaaaaaaactccaaacacttgtattttcttaacattgcttatcatttccaatttaaatgcacttgcaaatgaagaaggcaatactaatgaaaaaaatgatcaacccaaacaaatctctaatttttttagcccagaaagagggttcatatattcaacaggaattgggattggagttggattttttctaaattcaaatattaaacaccttatctttagaccttattatacattctctaataatacttttgattttttaatcgttgctatgatattaacaagggaaagccttaatatccccaaaaaaatgcaatactttaaatcttatattggaggaggaataaactggcacattgcaaacttaattaaaaaaacaaaatatttttccgccaccattggcataggtggtcgtttttacctatctacaaactttatagaagacattcgattttacgaaaaattgccttatgtaatagagccttatatgtttattgaaatttcttctaaaaaggcaattcctttaatggggttagactttaaaattgattttttatttttagatacatttaacatttcttttaattttactattagatataattttaaggacaaaaacgagatggaaacatgaaaaaaaggtcgaaattttttctttactgctatattttatgcctaacaggatttttatttttttcattaaatccaaaagccctaaaacaaattaaacacaaatttatgactatttagaaataatagaaataatacactgacattacaaaatctattccaataaaagaagcccaattaataccaaaaggatatcttactactcaaataataagcaaaaaacactataccttaggatatgctgaaagcgcaagacaatctgaatgggctgcttatccgcttaaaagagaaatggtagaactagcattaactttgttaaaatcaaaaaaaattaaaagaagtaccaaattctttgaagacaccaacattaagggcgcttttccaaaacttgaagattactttaaaagcggttatgacagaggacacatagtaagttctgcagatatgtctttttctgaaaatgcaatgaaagatacatattttttatcaaatatgtcacctcaaaaaagcgaatttaattctggaatttggctaaaacttgaaaaattagtaagagaatgggcaatctcaaaaggatatatatatattattagcgctgggattttaacagaaaataaaggatttattggtaaaaacaaaattttgatacctaaaaatttttataaaatagtactggcaattaataataacaattattatgacataatctcttttattatcccaaatgaaaaagcaaaagacttggatttggaaaattatgttgttagcgttgacttaattgaaaaaaaaacaaagatagatttttttgaaaaacttgattcaaaaattaaaaaaaatattaaaaaaataaaaaacacgcattcttggaaatttaaatgaaatcaatatttgcaaagttaaacgcttctatcaatctctttctttttataatttttattttggcaacaatagttatactgactttctcctataaaataaaatataatgaaaactatcaaaattatattctagaaatttacaataataattttataatattggttaataaattaaccatctttattgctgggatcataggctcgctgtggtcatacattaactacaaaagaaccaacaatatacaatttatatttttctattgctttattagctcatatacattagaccctattttaatctctgaagatttttttttaaaaaacaatctaaattcaagttattatttgtttacaaaatttatcctttttgtaaacactttttcattattaaatttattttttctcagtttatatatatgcgatttcaaaataaaatcaatacattatacaatttacattattttgatctttgcctgcatatatagttacacaatgcctattaattcgtacgaaaatagccaaaaccacggaattcttaaaatagaaaatacaaaattttacatagatgcattcttgctacttattttaacaaactttatagtagcctttttaagaaaaaaaagctttgactattttttcctttttgtttcaatgcttttaatattaagtggaatttacttgaatttgctaaaaatgccttatgcctttctcccaatctcaattggtataccaatctacttaaaaaaatcagggaaaattttcttttactggctataaaaaaaagaagttaaaaaataggacgaagctgaaacaacaagcggtaaaaataaattgtcataattagcagcatcaaaaagctctaccaatactgctaaaatcccaagaattaaagctactgtcaaataaggaaaaaaataataatatgaaaaaaaagtaacacaaaatacaacaagactgccagaaatcgttttaccatttacaagcttaaaagaaggaattaactttccaataagacttgcaaatccatcaccaagacataccgaaaatattccaatataattaaaaggatgcatagataaacaatatgatatcaatatacctaaaaacaaaaagacaggagaaaaagatactctattgggcaatatttttcttgattttaatattatgtttgaaatgtttttaaagaaaagtatttttttttcagtaattctaaaaatttcagaacttaagtataaaatcataaaaagtatattagaaaaaagccctatccaaaaatttattctataaaaaactaaaactattaagctaaaaatatgaaaaaattttctaaaaatttcatacttaatatcttctctaagaattgttcttttaaactcatcaaacatcatttgatctttttaaaatgcatattaaatcgacatttgaaaacattttttccaacactcattaaattcctcatttattgctgcaaataaattaaaataaacaaaaacctttttataaacctatgtcttataataaaattacttatattaattttacaattttttttcaaaaaaaatattcttacctaagagatttattataaataggcaatacttatttataaagagaagaattaagcaggttcccaaaaatgctagaaattgaagataaactatttttaaaattttgtgattttatatataacaacagtggaattcgttttgatgaaaaaaataaatttgttcttcaaagcagagtgaatgatgcagtacgagctcttgctcttgaaaacccatcacaactttataatttaataattagtgaaaaattaaaaaaagaatatttcttagatttggtcacaacaaatttaacaagattttttagaaattcgctacattttcaaacttttgaaaaatttgtaattccgaatttaattaatattaaaaacatagaaaaaaaaaataggattatcatctggtctgcgggatgttcaacaggagaagagccttattcattagcatttgtactcaaatcaaagcttccaaaagaaatagattttgttattattgcttctgatttaagcttaaaatctttgatgatagcaaaggaaggatattactcatcaaataaatgtgaaaatattcctaaagaataccgacactacatatattctcattcaaacggatataaaattaaaaatgaaattaaaaatcacataagatttgattatcataacttaaactttgaaagtaatttttcggaaattgatgttgttttttgtagaaatgttttaatatactttgatgaaaaatcaaaaataaaagtacttaaaaaattttacaacaatatgtctaaaaacagctatttatttataggacactcagaatcactttttgggctcaaccttccttttaaatttttaaaaacaccttgggcaataatatatgaaaaaaaagatactggctgtcaaaaagaaaaattcaaatcacaaaataaatataagttataatttaacaagaataaaatgggaaaaaagtaacggtggaaacaaaaatttctgtacttatcatagaatactttgctgtaaagagaaaacttatatcagaccttatcaattcatctccaaaactccaagtcattgcaactgcttctaacagcaaatttgcaacaaataaacttaaaaaacataaacccgaagtaatattaatgaatttagaagagaacaatattaaagatattctatttttggaggaaaaaaacagtttaaacaaaacaataccaattgtcgtcacatcttcaaatcaaaacctaataaatattgctgcttcaaagggcgccgatgatcttatattagtatctaaaaacaaaaaatcacatgaaatcaaaaaagaacaaattattaattctcttttggcctatggatcgatatctataaaaaataaaattgcctgcaataaggacatgaaaacaaaaaactacgaaagagctaattttattttaaatcacaaaaatgacatttcttcattaaatcaacttgaagaacatgcaaaagaaaaaacattaaatgaaaaagaaataaaaaaacttaaactgagaaaatttgacataatagcaattggagtatcagcgggggggcctgtagccttgaaatcaatattaccagaaatacctgaaagctttccgccaataataattgttcaacatatgcctaaaggatttacagaagaatttgccaaaaatcttaataatctatgtaaaataagcgtaaaagaaaccaccaataacgaaatattaaagcaaggatatgcatacattagctcgggcggatatcatacaaaaatcaaaaaaatcgatggtaactatcaaataaaaaccctcgatggtaaacatataaatggtcacaaaccatctattggggtattatttcaatctattgcagagattgcaaaagataaagcaattgccataataatgactggaatgggaaatgatggatcaagagaaattggagatataaaaaaagctggaggactaactattgcgcaagataaagaaagttctatggtttttggaatgccaaaaatagcaataaaggaaaacaatatagactatatagttccactaagccatatggtaaaattattaaaagctatactaattaatagctaaatttttttaaacaaggaatattttttggacaataaaaaagaaaacaccgaaacagaagactgtttttctcatgtaagtaaatttaatatacacaataaaacaatatacatacttggaactgctcacgtgtcaaaaaaaagctcagaagatactgcaaatttaatagaaatcttaaaaccagactatattgccgttgaacttgatgaagctcgctatcattcgatcttaaataccaatgaaaatgaaaaatggagaaacttagatatagataaagcattaaaacaaggaaaagctttctttctcataataaacataattcttagtaattttcaaaaaaaattagcaaaagaacagggaataaaacctggtgaagaaatgaaaacagctattttaaaagctaaaaaacacaatattccactaattcttgctgacagaaaaattgaaacaacactaaaaagagcttggatatctattccaatatttgaaaaagcaaaaataatctcaagccttttttccctaacagatgcaaaaattacaaaagatgaaattgaaaaactcaaagaacaggacgctctttcaaaaataatggaagaactttccaaagaaatacccaaagtaaaaaaagttttaattgacgaaagagacgaatttattacaaacaaaatacttgaaggagagggcattattcttgccattgtgggtgcaggccatgtaagcggaataatgagaactttaaaagaaataagtcaaaataaaaaaataataaacgttgaagaactcgagaaaatacctaaaaaacatttttcatttagcaaagtgctatcttacttgattgcaatttcaatcattttactaatagtaagctctttttactttaaaggatttgattttgcttacaaaaatttaaagctttggataatatctaactctattttttcaggcatcgcatcgattttattaaaatctcatcccttaacaattttaacagctattataggttctccaatattctccttaataccattcataggaacaggtatggtagcagggcttgttgaagcttatataaacaaaccaaaagtcaaagactttgaaaatctacaagaagaattgtcgacaataaaaggatatttcaaaaacaaagttacaagaattctattaatagtgatttttgtaaaccttggatctacaattggaacaatcgtaggacttaaatttttattaaatgttttcaaataaacccttaaaataacaaatatttaaacaggagtatatatggggcttgtatttttaggtcctccgggttctggaaaggggactatttcaaaaattatttctaatgaatttaaatatcaacacatttcaacaggagacttatttagagaaaatattttaaattctacggctcttgggcaagaaataaaaaaaattgttgaaaggggagaactggtccccgacctaattacaatcaaaatagtagaagataaaattaaagctattaaaaagaacaaagattttattttagatggatttccgcgcaatatttgtcaagccgaggctcttgacaaatttttgccaaatgtaaaaataataaattttttaattgatgaagagttagtgataaaaagactctcgggaagaagaatttgcaaatcttgcaataatattttcaatatatataccctaacaacaaaaaaaaatggtatttgcgacgtttgtgggggagatctttatcaacgagaagatgataaagaagaatgcttaaaaacaagactcaaagaatataaattacaaacaaaaccgctaatagaattttactcaaaatgctctagacttaacaatgttgatgcatctgttaaaattgatgaaataaaaaaaaagataattaaaataatgttaaaaaaaaattaaatggaaaaggtattttaaataaaatgttaataaaaaaaatttgcttttgtttgttacttttgcaagcaaaaataattctttcccaagatcaacagaacttagaatttaataatgaatatttttattttaattttcaatctgcttattatcctccccacgagctgggtacaaatggaagcggcttttcacaaagctttaaacatcctaacttccaaaatattgacccaagtttaaaaattccagtcaattattgggggggaataaaactaatatcatatttgggctactataaaaattttaaagccctaaacaatcccaattctatattttttaaaaataatggtatagatatagatttaaatatcggattgtctcctgtaattgtctcatttaaaagcacagtaagctttactcctattgcttttttaaatttatatgcatcaaatgaacttggcataggttggcaagcttttggatttaaaggagtaggcgtacacattgaaaatgggaaatattcaaatgctgttgaattttattcagaaataacagcggggggacgattccaatttgacttaaacgctatttttcaaggagaatggacacacattattacagttattggaaatgattttacatacttaatcaatccccatgcaaaaaaagatcaactttggaaatataaagcagatgatggtaaaaatataaatggcatgctaataaaaccttacgctcttttggcttacaaaatgccaatacctcttaacaccataggcctgctttatgaaggaaaaacacaaattggcaaagaaagaaacataagctcttggaaaaacaaaggctggggaagtgatattttttatcacaacatttctattgttgctaattttgaaattatcaaacctttaacacttggccttcaatttaaattatctacaaatcccacatacacaagtaacacagccggactggctgatatttcaaaaagaatagcaactggcaattcttatttttattacgattctattggaatgtctataacttataaatactaaagtctattaaatataaatttaatatctaaactgatttcttccagaaactttagcctcataaagcttgcgatcagcaagccttatgatattggtaaaattgttatcaataggaacttcttgagcaagcccaattgaaacagtaacaatgccagaaacactactgtgctcatgaactattcttaagcgttttatatcattaatcattgttttaataatactaaccatttcatttagacttttgttgacagaaaaaaaaataaattcttcccctccatatcgagcaacatctattttatattttaaggaaaccttatataaggctttagcaatcaatttaagacattcatcaccattggtatggccataattatcattgtaatttttaaaattatcaatatctaacattccaacaattattatttctttactttctaaagctttcatccacgacttagaaaatttatccataaaaaatcttctgtttggaatttgagtaagcccatcaattctagacaagcttttaaaataatctcttaacctttttaattcaagatgtgtcttaactctagcatcaattattcgactattaaaaggctttaaaatataatctactccaccaacgttaaatccttcaagctgagcatctgtggaacttcttgaactaatgaaaattacaggaatctctttagtatcgggatcgctttttagctttctgcatacctcataaccgttaatatctggaagacctatgtcaagaagtataagatcaggactatctttttcaacttgctttaaagcatcaagtccatttgttgcaacctcaatctcgtaagcaccttgcaatatatttaccaataaatctaaattgtggggagaatcatccacaattaaaagcttctgattctctgcttcaaaagctttatctttaattatcatttccactgctaatatctcttattattaagcatttcaataatctcttcaagaatcttagagctctcagcaaatctatataatcttaaatttctgcgaagatcactaaataatacctgaatattatcgtctaaaacatatttattaatgctctcaagaatttctttgtattctcttggctttctagtcttaataccaattaaaagtttgttgagaaggtttaaaaattgatcattatttttaaaatatagcttgttctcactaacaatctcagactcaaacaaaatattttcctttatgtcgcttattagttgaaataaatcatcttttacaaaagaatacatttttttcaactcagaaattgaatctttacttgtttcaattttttgaaaatctttatacaattcgctacgcatattagaaagagctccagatattgaatgagatatatccttaattaaagacaaatcttcctcatcaaaagctttttccaaatcaataatattaatagagataaaatcaacaagccctctacataattcagaatatgatacatatgaaagatttaattcttttaaagccctattaacatctaaattaggaaacttaacaagttgattcaaattttcattctccccaatatcatcaacttcaaactgtaagtatttttttaatatagttttaattgaacttatgtgtattggttttgagatataatcattcataccacttgcaagacacttgtctttatactcttgcaaagcatgcgctgttacagcaaccaaaacacaaggctttaaattctttgccttttcaaattttctaatttccttagccaccgaaaatccatcatatcttggcattcgtatatcaataaaagagatagtatattttttatcttttaaagattttaaagcctttactccatcatctacaacatcaataaaattttcattaatgcctataacaacaagaatatctttcaacactttttgatttacctgattatcttcagctattaaaacattaatgggctcttttatccttaaagcactatctattggaaccaaatcctcaaaatccatttctgggttaaactcttttttataaagaatagagcatataccaagccccattaaaggctttttaacataaccatattttaaattttttagagctttattatctaaataataaaataaaaaaataatttgtacatcagaatttagtctttcaatattattggcaagtcgaataccctcttgaatattatcgttatttacatttatataaacaaaattataagaagggtatttcttgaagactttataagcatcctcaaaagacgctacatagcgcacattagaagagcatcccaataaaatcgaacagtgctcaaaaattttaatagatttttgacttaaaagcacatttaatactttattgtcaccatttactgattgaaatctattgattgacaattttttacttttaagctcactacccaataaaaagggcaacataaatgaaaaagttgtaccctctcccaccttgctatcaacagcaataccaagaccacccattagtcttataagctctctagatattgacaatcccaatcctgcaccttcatgaacccttgaagaagaatcatcctcttgtttaaatatttcaaatatcttagaaaaattttctttttcaatccctttgcctgtatctattaccttaaattcaactgtaaccaaaaccctattaccatcagttcttgttctacatacttcttcataatttaaaacaataacaccatcatctgtaaacttaaaagcatttcctattaaattaattaaaacttgtttaatttttacaatatcaccctttatataattattaaaaatagatttagaataagagaataaatcaatatttttctttgcacattgagattgaaaagcttttaaaaccatttccatttcactctctaaatcaatctcttgactctcaacatataattcattgacatctattttagacaaatacaatatatcatcaattaaagaaagcaaagaatcagatgaataatttatcatcctaacataatctttttgaacatctgtaagaatagttgtatccaaaagctcagtagccgccattattccgttaataggggtacgaatatcatgactgacattggctataaaaatggttttagcagcattagcggcttccgcaatctttttttcattcatcacaaaagaatatcttcttttctgctcaaatgataatctgaacataaatataattacaaatcctaaaaaagtaaaataaaatataatgaatgttatcactaaaaatttgaaatttttaaacctgatacttctggatttataataaatatcaaatttccaatcatttaaatacatctgactgtcaacatttgaacgcataacaactttttgaataatttctttcaagatataatcttgattataaatagcaagactcaaatcaaaagccaaatctctaaaagtaggaattttttcaacatcatcaatatttaattcctcaaaaacagcagcagctgtatactcatcgctaataatcccatctacctttcccttataaagaagaagcaacgcttcattaaaactgcttaccagaataagctttgatttaatattagaagccaaatttttactatataaaaaatcaagtatagcaaacttttctaaagatctagatggaagcacccttttcttatttgaaaaaatataaagtggaattcgagaatttaattttatgttgaaaacattatctaaatttgaatcggttgcattagtatttagcatatcgatttttccagatttgattaattttttaagatctaaactgctgtgtactttaattatgttaaatctcaaacctgaaaacattctaatcttatcaagcaaaaattgatttattcctttataattatttgcctcaacataatctattggataccaatttttaacagcaagatttaatttattattttttgataaccaaattttttcttctatattaaatttaaccttattcataattttataactatttattctagaactattaatctcttctttatccaaccaatttttatctatttgaagcaaagattcaaatgaaatatcatcaaatatagaattgagaatatatttaataaccttataaatcctattatcaatggctaatactaaaaacctatttttattaaaaatcgaatcgtaagattttaatctaccgttatatccatttaattttaacaaatattttgttgttattgaattttctataaacccatatgaattattaacaatatctataaagttattaacaatatctttattcttatttaattgaatattattaaaattaaaatcaataaactgagaatttattggaccagcatcattgcttaggtctttagaataaaatttaaaattaagaggatatattggcttacttactacataattaacattttccaacacactatcattgctaataattcctccaaaaatacctactgattttccatctaatgatttcttaatatcctctttggaaaatcccttaaaaataggtttaaagatatgttgtcttgagagaagattccacaaatccactaaaatgccagacaattttccctgtgaattaataaaacttaaaggaggataatcattatataaaccaacatcaacaaaacttcccttagcattgctatctaaaaaagaaaaaacaagttcctcaggcattttcattaaatatgaaaacaaatctaaattcaaattctttactatctcaggagcatttctactaatagccactctatttttgatactataaaaaacatccccggtaaaaatcacaagatcttcacttaaaaagttatttgcaatataatgtaaagtcttgcaatcaccatatatataatcaactttatcgttttttaaggccaatactaactcttgagaattatcagccaaaaaaatggtgttaacgttttttaaccttaagatatcttcatatattgtatttttaataactcctatattaaaattggataaaaatgttgaatgggtatttttatattttttattagagtttttaaaaaataaaattgaaatactcctagcaagctcacttttaaaataaaaaaaatcatttaattttacattataagttaatcctaaatatattgcttcgtcttcaatttcactttcatttaaattatcaatatgctcaaccataatatcagcattattatcttttgcccatttatctaaaatagaaaaaataagtccttcatattctcctttattattcttgtagtaaaaaggaaaaaattgatctacaagcttaaacttgaaaatatccttagaaaataaattgacgttgacaaagcaaaccaaaagtaaaattaaaaaattagtacttaaaaagtttgcttttttcatgttattttaaaattcccttattaaaaacaacagttttaccactgtgtaaaaataaatatacacaataaattcaaggtttaaagtataaaaacaaaaaccctggcaataacctactctcccgcgaactcgcagtaccatcagcgaataagagcttaacttctgtgttcggaatgataacaggtgtttcctcttttctttaaccaccagggtttttacaaggaagacaaaaatatggccaaagatacgggtaattagtattagtcagcttaatatattgctatacttacacttctaacctatcaacctggtattcttccaggacccttaaaggatatctcatcttgaggaaggcttcccacttagatgctttcagcggttatcctttccgaacgtagctacccagcacttacccttggcaggataactggcacactagaggttcgtccatctcggtcctctcgtactaaagatagctcctctcaaatatccaacgcttgtggcagatagggaccaaactgtctcacgacgttctgaacccagctcgcgtaccgctttaaatggcgaacagccatacccttaggacctgctccagccctaggatgcgatgagccgacatcgaggtgccaaacccttccgtcgatgtgaactcttgggaaggataagcctgttatccccggagtaccttttattcgttaagtgacggcgcttccacttgccaccgccagatcactaagacctactttcgtatctgttcgacttgtcagtcttacagttaagctaccttatgcctttacacttacagagtgatttccaaccactctaaggtaacctttgcgcacctccgttactctttaggaggcgaccgccccagtcaaactacccacctggcactctcctcatatttctataagttagaaacctaattaaacaagggtggtatttcaagattgactccactacccctgacgagatagcttcaaagtctcccacctatcctacacatatttaatcaaatctcaataccaagctatagtaaaggttcacggggtctttccgtctaaccacaagtaatcggcatcttcaccgatacttcaatttcaccgagctccacgttgagacagcgtccaaatcgttacaccattcgtgcgggtcggaacttacccgacaaggaatttcgctaccttaggaccgttatagttacggccgccgtttactggggcttaaattcaatgcttcgcataaactaacatctcctcttaaccttccagcaccgggcaggtgtcagtccctatacttctctttacagatttgcagagacctgtgtttttggtaaacagtcgtttggaccatttttatgctacctaattgcttaggtcgtacttatcccgaagttacgtacgtattttgcagagttccttaacgtggattctctcgcgcgccttagaattttcatcccacctacctgtgtcggtttgcggtacggtcccttatagcctaaccttagaagctatttcttggcaccttgactacctacatttcatgctacctaaatagcactcatcatcacatcttagctctcttaacggattttcctattaagatcatcgccttaatgcttaaactaggacaaccatcgcctagcagtagttaacctcatgcgtcactccatcgaaactataagaggtacgggaatattaacccgtttcccatcgactacacttttcagctttgccttaggggccgactaaccctgggaagacgacctttacccaggaaaccttaggttttcggcgaatgggaatctcacccattttttcgttactcatacctgcattctcacttctgatacctccatcaaactttccagcttaacttctctggcttacagaacgctcccctaccatcttaactttcgttaagatccaaagcttcggtaatgtgtttagccccgttacattatcggcgcttaagtactcgaccagtgagctattacgcactctttaaaggtatggctgcttctaagccaacctcctggctgtttacgtacctaaacctccttttccacttaacacatttttgagaccttagctgttggtctgggttgtttccctctcgactatgaaccttatcgcccatagtctcactcctattcatcatttaatagcattcggagtttaactgagtttggtaccctttgacaggccctagctcaattagtgctctacctctattaaactaaaataaggctgaacttaaatccatttcggggagaaccagctatctccgagtttgtttagcctttcactcctattcacagctcatccctgcctttttaaacagactagagttcggccctccacttggttttacccaagcttcagcctggccataaatagatcactcggcttcgggtctaccacatctaactaaatcgcccttttaagactcgctttcgcttcgactccagcacttctatgctttaatcttgctagacatgataactcgcaggttcattatgcaaaaggcacgccatcaccgcaataaattacggctttgactgcttgtaagtctacggtttcagttctatttcactcccctcccggggttcttttcacctttccctcacggtactcttctctatcggtagctttctagtatttagccttggagagtggtctccccagcttcaaacaaggtttctcgtgcctcgtcctactcaggaacattttaaaaagatatttacatttaaattacaggactatcaccttctttggttaaactttccagattattcttctatataaatattttgtaacttttttgcttattacagactaagcctaaacgtcctacaaccccataaatgcaacgctctgcagcttgacacatttaaagtttgggctactcccttttcgctcgccactactaagggaatctctttgatttcttttcctcagggtacttagatggttcacttcccctggtatcgcctctattatttaaataatagatagctagcatcttgctagctggattactccattcggtaatcttgggatcaataaatgtttgcttctcccccaagcttttcgcagcttaccacgaccttcttcgccttaaagctcctaggcattcaccatagactcttattactttgaccatatttttatcttccatctctattttgccaatttatttatacaacataaaataatatatatctttgtttaatacatgtcaatatatattttattttttatgttatttaaacaacacattcaaaaacaccaatatttaaaaaacataaaaataaaatcaaagtttaaagtataaaaataaaaaccctggcaataacctactctcccgcgaactcgcagtaccatcagcgaataagagcttaacttctgtgttcggaatgataacaggtgtttcctcttttctttaaccaccagggtttttacaaggaagacaaaaatatggccaaagatacgggtaattagtattagtcagcttaatatattgctatacttacacttctaacctatcgacctggtattcttccaggacccttaaaggatatctcatcttgaggaaggcttcccacttagatgctttcagcggttatcctttccgaacgtagctacccagcacttacccttggcaggataactggtacactagaggttcgtccatctcggtcctctcgtactaaagatagctcctctcaaatatccaacgcttgtggcagatagggaccaaactgtctcacgacgttctgaacccagctcgcgtaccgctttaaatggcgaacagccatacccttaggacctgctccagccctaggatgcgatgagccgacatcgaggtgccaaacccttccgtcgatgtgaactcttgggaaggataagcctgttatccccggagtaccttttattcgttaagtgacggcgcttccacttgccaccgccagatcactaagacctactttcgtatctgttcgacttgtcagtcttacagttaagctaccttatgcctttacacttacagagtgatttccaaccactctaaggtaacctttgcgcacctccgttactctttaggaggcgaccgccccagtcaaactacccacctggcactctcctcatatttctataagttagaaacctaattaaacaagggtggtatttcaagattgactccactacccctgacgagatagcttcaaagtctcccacctatcctacacatatttaatcaaatctcaataccaagctatagtaaaggttcacggggtctttccgtctaaccacaagtaatcggcatcttcaccgatacttcaatttcaccgagctccacgttgagacagcgtccaaatcgttacaccattcgtgcgggtcggaacttacccgacaaggaatttcgctaccttaggaccgttatagttacggccgccgtttactggggcttaaattcaatgcttcgcataaactaacatctcctcttaaccttccagcaccgggcaggtgtcagtccctatacttctctttacagatttgcagagacctgtgtttttggtaaacagtcgtttggaccatttttatgctacctaattgcttaggtcgtacttatcccgaagttacgtacgtattttgcagagttccttaacgtggattctctcgcgcgccttagaattttcatcccacctacctgtgtcggtttgcggtacggtcccttatagcctaaccttagaagctatttcttggcaccttgactacctacatttcatgctacctaaatagcactcatcatcacatcttagctctcttaacggattttcctattaagatcatcgccttaatgcttaaactaggacaaccatcgcctagcagtagttaacctcatgcgtcactccatcgaaactataagaggtacgggaatattaacccgtttcccatcgactacacttttcagctttgccttaggggccgactaaccctgggaagacgacctttacccaggaaaccttaggttttcggcgaatgggaatctcacccattttttcgttactcatacctgcattctcacttctgatacctccatcaaactttccagtttaacttctctggcttacagaacgctcccctaccatcttaactttcgttaagatccaaagcttcggtaatgtgtttagccccgttacattatcggcgcttaagtactcgaccagtgagctattacgcactctttaaaggtatggctgcttctaagccaacctcctggctgtttacgtacctaaacctccttttccacttaacacatttttgagaccttagctgttggtctgggttgtttccctctcgactatgaaccttatcgcccatagtctcactcctattcatcatttaatagcattcggagtttaactgagtttggtaccctttgacaggccctagctcaattagtgctctacctctattaaactaaaataaggctgaacttaaatccatttcggggagaaccagctatctccgagtttgtttagcctttcactcctattcacagctcatccctgcctttttaaacagactagagttcggccctccacttggttttacccaagcttcagcctggccataaatagatcactcggcttcgggtctaccacatctaactaaatcgcccttttaagactcgctttcgcttcgactccagcacttctatgctttaatcttgctagacatgataactcgcaggttcattatgcaaaaggcacgccatcaccgcaataaattacggctttgactgcttgtaagtctacggtttcagttctatttcactcccctcccggggttcttttcacctttccctcacggtactcttctctatcggtagctttctagtatttagccttggagagtggtctccccagcttcaaacaaggtttctcgtgcctcgtcctactcaggaacattttaaaaagatatttacatttaaattacaggactatcaccttctttggttaaactttccagattattcttctatataaatattttgtaacttttttgcttattacagactaagcctaaacgtcctacaaccccataaatgcaacgctctgcagcttgacacatttaaagtttgggctactcccttttcgctcgccactactaagggaatctctttgatttcttttcctcagggtacttagatggttcacttcccctggtatcgcctctattatttaaataatagatagctagcatcttgctagctggattactccattcggtaatcttgggatcaataaatgtttgcttctcccccaagcttttcgcagcttaccacgaccttcttcgccttaaagctcctaggcattcaccatagactcttattactttgaccatatttttatcttccatctctattttgccaatttgtttatgcaacataaaataatatatatctttgtttaatccatgtcaatacttattccaatattttaataaataaattttcaaaaatacattataagtaaaaaatttatattttaaatagaaaatcctgctaaaaataaatcaaatggattaaacatttaaatacaaattattaatatttaatattaagcttaaaaaaatcaattaaaaacctagcaacgccatcctcattattactaaatcttgttatttcattctttgctaaattaattttaagaaattcattggcatttttcattaaaacccctttaccaagatttttgagcatttcataatcattattattatctccaaaagctaaaacatcacacaatggaatgctttcaagaaaagcaatatttttaatagcattatatttattagcattaatattggtaacctctaataaatctttagaagaaaaaaacactcttgtgtcctggaaatctttacttttaatctcagtgtcaagtttattaagaattgccaaatcgtcacaataataaacaatcttagaaacagaatcaacgtttagtttggtcaaatctccaataataacatttaagcccaaatctttaataaaatgtttcataataggacttttaacatctgcattagaataccaagtgtcaaaagtataaagattaacatcaacattatctgtatttatcttgagaatttcttttgctaagtcataattcattgcgtatctaaaaattaaattttcttgcaaaaacacttcagccccattcgccgttacaagataattttcattaatactaatttcttttaattggctccttatatttttaacttcactcaatcttctaccggttgcaataattattttaaaatcttccttcaaagccaaaagaacctcaagagttaaaaaggcaatctcatggttattattcaataaagtgccatcaaggtcaaaaaccagcattttatatcttttataattagaattcatatataaatctctcttttaagatatactatcacaaataatttattcttaataaattattcttaaagcataaaataataaaatttaataatattatatttttttaaaaaaatttaaaaaaatataattaaatgaaaatcaacgccttgaaacaaatttattatctttgatataaaacctccaaagcttgtttatatcactctcttgtgcataattaatattgattctttttgaacaaactatattaaaatctagattcaaacctctttgtaaaaaaagctcattattcccaataagatcaactttattaaaagttaaatcaatgtttaaaaattttgtaagttttccaggaccattagtaagaatgctcttctctcccaatagtggagaaataggctctacacttctgattaaaacagcttgaggattatttttatctgcagtcacaacgttaaacatataatgcataccatatattatatacacataagaatatcctcctattctatacatagcacttgtgcgatttgttatcttgccgccataagaatgacaagcgctatctgttatccccatataagcttccgtttcaacaattctggtaactatttcctctttgtcgatctttctgatcaacaaattaccaagcaataactttgcaacggtagtagcatcttgcaaaaaaaaatatcgatccataagctcaattttaaaacaaaataataataaaaattattaccaaaacacacatgtaaaatatgaaaacatattgcctagaataaaaataaaaactaaaatcatttaatcacccagtaaatacatattttaaataaattcttggttgattaataaatttttttgatttttaatcaaaaaaatttaaaaagttgaactagttcaacttaaatcagcttatatgaaaatgctaatctaaaatacaaaatatcgaatattgacaaatatataaaaaattataaactatatgcaatatctcttacatcttgaaaagatataagagatattgacaaaatcataagatttaaataaaatttgtaaagaattgatatgcttaagggatcatagctcaggtggttagagcgcaggtctgataaacctgaggtcggatgttcaactcatcctggtcccaatgtattccattgttttaattacgacaatactgttttaagctataattaataagaaaaacaaaaatttattcaatttctatattaaggtatacacgattactaacaattacaacttcatgccattgagtgtcgggcaaatccaaactgaaatctgctttatggtattttgcttggcttttttgagttattgttgcaaacttgtaacctaaaacataagagcgataacgatttaatgcaatctttgccttcctccaacttataactggcaatcttatccgaatccctaccactaaatactggcaacgataataaggatttaagctcgctacaatacttgtccttctctcagacatcacacttagtaatctacattatttcctaactaaaaactatttactaaatgcagatcgtttataaaataggctgctgaaaaatacaatcctgtttaatccttgcactttagcgaaacaacttcgggttttatcgaaagcttgcttttgcttctagacatttttcttaatatcaacagatctcaacttaacccagaaattttaacttcttgtgtttcacattccaacaattactttaacaaagttacttaaaaacatacttaattacaatttagggcataagcccaatggaggttaagggactcgaacccttgaccctcggcttgcaaagccgatgctctagccaactgagctaaacccccaaaatgacctaaaattaagtctaagcctaataaaactatttaatatcaataatttaatacataaacttctcttaaacttacataaataacactggttttaaaaactctcttatcaaaagaaaagagtagggaagagttaatggaattagccttagtttatctttctcttagaaaggaggtgatccagccgcactttccagtacggctaccttgttacgacttcacccccctcactaaacataccttaaataccttcctcccttacgggttagaataatagcttcgggtatcctcaactcgggtggtgtgacgggcggtgtgtacaaggcccgagaacgtattcaccgtatcattctgatatacgattactagcgattccaacttcatgaagtcgagtttcagacttcaatccggactgagacctgctttatgcgttttgcttcacatcactgtttcgcttcgctttgtacaggccattgtagcacgtgtgtagcccaggacataagggccatgatgatttgacgtcatcctcaccttcctccgacttatcaccggcagtcttatctgagtccccaccattacatgctggtaacagataacaagggttgcgctcgttgcgggacttaacccaacacctcacagcacgagctgacgacaaccatgcagcacctgtatatagaccccaaacggggaataattatctctaactatatcctatatatgtcaagccctggtaaggttcctcgcgtatcatcgaattaaaccacatgctccaccgcttgtgcgggcccccgtcaattcctttgagtttcactcttgcgagcatactccccaggcggcacacttaacacgttagcttcggtactaacttttagttaacaccaagtgtgcatcgtttacagcgtagactaccagggtatctaatcctgtttgctccctacgctttcgtgactcagcgtcagtcttgacccagaagttcgccttcgcctccggtattctttctgatatcaacagattccacccttacaccagaaattctaacttcctctatcagactctagacatatagtttccaacataggtccacagttgagctgtggtattttatgcatagacttatatatccgcctactcaccctttacgcccaataatcccgaacaacgctcgccccttacgtattaccgcggctgctggcacgtaattagccggggcttattcataaattaacgtcatcactttgtcatttcctacaaagcttattcctcatttataaaagaattttacaatctttcgaccttcttcattcacgcagtgtcgctccgtcaggctttcgcccattgcggaagattcttagctgctgcctcccgtaggagtctggaccgtatctcagttccagtgtgaccgttcaccctctcaggccggttacttatcattgccttggtaggcatttaccctaccaactagctaataagacgcagactcatctacaagcgaagctttaaaggcttcctttcatcaattaacaaattaactgaccttattcggtattagctactatttctaatagttatccccatctcataggtagatcatccacgcgttactcacccgttcgccactgaatgtattgctacatcccgtttgacttgcatgcttaagacgcactgccagcgttagttctaagccaggatcaaactcttcgttattttatttttttatttaaaaaaattaacaggttttgtttattcttttggcttttaaccttacttaactcttcccttctctcatcttccaataatcatttcaacctttaatactttaacaaaataagaatcatattgtcaatacctttgcattatttttattaatataaaatgtaaaaaaataaattttattaataaacagtgataaaagcattaacagccacacttttcattagcaggcaaagttgtaaaaattttttttaatttatttcccaatttagcttttaaataatcaaaaaaggttctgaaattttcattatctcctttaaacttaatccacagttctttaaaggttaaaattccttccctaagatccttgtaattggaaaaagcagcagcacagtcgctatacattaaattataaaaatcagaatcttgtttatctttaaaaaaatctatacttggtattttcttggcaaaggcgaatcctctctcataagccgtgccagaatcaacataattaaccaaggctaaaacaatatcgctactaactagctcttttaaatctacttctcttatcttctcccttatatctctatttgcaaacttataatcaaccttttcaagcaatcccatctttttgacagcatgatgctctggagaaaatacttctaaattaaactcttcaagaaatttcaaaacctcatcccttagtttaatttcctcttccttaaaaaatggagaggctaaataaatcttcataaaaacccctatcaaaattcaagtataacacaataaatcaatcgagcaaaatcaagaataaataaattttaaaatccaagtagaaaacatttattatgaacgacttctgctgactagaatagtaaactctcctttaaccttatccttactcgattcaaaatatttttttaattctaaaggtttgccaatttgatattcttcataaatttttgtcatctcgcgaccaataagaaccttcgcatctaaactaacagaagaaatttcaacaagcaatttcaaaattctatgaccagattcaagcagaacaaaagcatctccccttttatatagctcagcaattcttttaaatcttttaaggcctttgttaggcaaaaatccctcaaaaaacactgatttatctctaaaaggattaacacttacaattgtattaaaagaacttactccaggaattggacaaactttgtatccctctctaaaagcagcagcaactaataagctacccggatcactaagccccggagtaccagcatcgctaacaaaagcaacagaatttccttttgccaaataatccaatagcaagcttatcttcttgttttctgttacggcattacaagaaatcatttttttattaattttatatcgagacaaaagtttgctagttactctcgtatcttccgcaaagataacatttaccgattttaaaacatcaattgctctataagtaatatcttctaaattgcctattggcgtaccaacaatatataacacaggcccttttaattcctccaaaactaaaaataaataaaatatattaaaaacatttttcttaatgataaaaatccaaaaccttttacttaccaaatacaagaataagacataagccatattttatatgtctatcaaaatacttgcttttgtattacatttagttatatcattaagtattaatgattaaaaagttaaaagaaagggaaaatttatgtttgcattaattagaaaaatatttatgatctattttttatgcattactcttgcaggttttgccatgatttttattgacagcaaatttaccgaacagcctaatgttaaagaaaatcaaagcaaaattaatcaacatacaattgaacccaatttaatcatgtttacatcttctataggaggatttttaggtgtttatgttggaatttggatctttaactatgacaaaagcaatttttacctaaattggggaaatttaataatattaatatacaacatagccctaattatcactgtatactcaaaatcacatagttagctaacatatggctcaactattttcataatttataaattattaactataatacctcttttaatcatatacttataaacctcttcgggattttctaagctttcaatcaagctttctgccctgtcatttattttttctaccaattttttataagccactttaattcctctgctttctaaaaaatcctttgcgggttgagaaacaaccccagcttgaacattttgaagccctatattataaataataacggctgctgccttgcccacaactttatcataaatttcaagtccttctttattctggatatacttattgataaaattatctacttctaaaagaggcttcaatcctctttccatattagaataaagtattttatgatctttaaacaaccttaatgttggattcaagcctgatatcatttttacctcttttctggatatttataaaaatcaataataaaaacaaacactattaataatatacataaacaataaatactgcaatatctaaaaagatagtatacttacgttatatgatgtttgtgccaaaaaacaatagtaattctaaaattgaaataaagaaatccatctttgtttcatatatttttaatattgaaaaaaaagacgatataaataaaactattaaaaaatacaaaataaaatttaaaaatgctacgcatgtggtttatggatttagaatcggaaacaaaaactcatttctaaatggaatgagtgatgatcgagaacctaatttaacagctggaaagcccacattggatgccataatacataacaatttaaccgatactttaataatcacattgcgatattttggaggcactttacttggtagagggggattaatcaaagcgtattacaagtctgccaaagaagttattaataatacatctataatggaaaaagaggaattagaaattttaagcttaaatttaacttacaaccaatacaattcattattaaaaatgaaaaataaacttgaaatagaaataatagattcaaacttttcaaacaaaataaacacttcaattaaattcaaaacaaaaaataaacaaaaaatatcggaattttttatagaaaatggcttaattcaagaaatcttaaagtttaataaagaataatatgcatgtcaaataatcaaatatttaaaaactaatttaaaatattattatttttatcatttatgttttaaaatataaaaacaaaaccaaataaaaagagaaatttatatgaaaataatatctgtaatcaatcaaaaaggaggcgtaggaaaaaccacaagcgccattaatatttcttattcaatgaccctgcttaataaaaaaattcttctaatagatattgattcgcaaggaaactctactagcggcacaaatacctcaaagcatatagccgaaaaatcaagctatgaacttattaacaaaaaaataaaggtcaaacctttaaatcattttggattagacataattccttctagcattaaattagctttgcttgaaaaagaattaataaatgaactttcaagagaaaattttttaaaaaatgcattaacactgtatgaaaaagacaaatatgattttattattatcgactgcccccctacactttcaatattaactataaatgcacttattgcaagcaattacttgttaataccaattgaaacggaattttttgcatttgaaggcataaatcaactaatagatacaataactactgtaaagcaaataaataaaaatttagagattgcgggtgtttttataaataaatacgacataaggaacaaaagtaaagaaaaatatgtaagctcgctaaaaaaagtttttaaagaaaagcttttaaatacaaaaataaggaaaaatataactatctcaaaatctcaagaagcaaaaatgcctgtatatgaatatgacaaggaaagcaatgctgcaaaagattttttagagctctcaaaagagataataaacaaaattaaggaatagctatgtctgacaatttagaaactttaatgtttctaatgggtaaaaaattagaaacatcttcaaataattcagaaaatactgaaaaaaaagaaattatttcgattgaaagaaaaaactttgactacaataagctagataaagatatttctgattttttaaaaaaaaagcaatatgaaattttcaatattttcaacaacacttatacaaaaattggaaagatacttaaagacgctcaagacaaattaaaaggaaacaatcaatataacgggcttttttatcagtggttcaaaagtatgggatttaaaaaagacaaggtttacgccttaatatcaagatacaatctgcttgtcgaaaattccgacaagcagctcactatagaaaaattacctttatcattatcatatgaaatatctaaaaaatcttgtccccctattttaaaaaccgaagttctaaatggaaaaataaattctttaaaagaatttaaaattgtttataaaaaaagttttgatttaaaggatacgcgcaaaccattacttaagaaaaacgaaaaatatgaaaatgacataaaagaagtattagattttatattaaaaaatataaaagaatttaaaaatatcgaatttaacaaattaagacaagaaaacttaaaattattttttaattctattttggaaataaagaaaaaaataaaatatattaaaaataattctatttaaatttacagctgcactaataagaatatataaaatatattcttattgttcattttttaaatattatttttttacttttaaatttaactacaaataacaaaatataaactttgcccttcttttaaagcccaatatttctttataaaaactaaacaattttaaaataagcttaaaaaatttatgcattgtgacaaatgcctaaaaaataaaaattctcataaaatattttacaatctttaaattataaaaataatttagctactatgaccaaaaagggaaacaatcctttttaaatcgccagcagtaaaatactctatctctattttgcctttattttgattccctttgatatctatttttgtttggattttatcaaatagaaattcttttatattatttaaaaaaggatcttgttctagctctcttttttttactatggatttggaaaaatttttaacatatttttctgcatcccttacagaaaatttttttttaagtataattaaataaagattatacctgtcttgcctgtcttttaaggataaaataactttagcatgcccaaaagaaatttcttttctatgtattgcatttaatatttcttgctcaagatctaaaattctaactaaatttgaaatataggtcctgcttttaccaattttttcagataaatccttttgagttaacgaatatttattcattatatttttataggcataagcctcttcaacaggagtaaaattttctctttgaatattttcaaccaagggcataaaatctttacaggattcttttatgtcaacctctatgacaggaatatttgtcaactgaataagtttagcagccctaaaccttctttctcctactattattttatatctatcatttgctttacaaacaattaaaggttgcaaaattccattttcttttatagaaatgcttagctcttctaattcaacaagactaacagatttccttggctgatcattatcaatatctaaaagatgaatatctatcattttaaaaactccatccatattgtcaaaacctcctacaacacaaaattttaccaggttataatattgaattacaatttaagaataaaaaaaaagaatgttccacgtggaacattcttaaacaagaaaaaccaattctttatttaataaattttgaaacagaaaccaagctgtcattatcaagaaataatacttgaattcctctagcatctttgccttgttcagatacttttccagctactgttcttaaagcttttgaacgtttacttacaagcaagatttcatcatcctctgaaactgctatagcatcaacaacactacccgcttttttatcagattttttataactagtataaccagtggctcctcttttaagctcagatattttagacatgtttaacctttttccatacccattttcagaaacaatcaaaagataaggattttctttaaccgataaaactttaacaaacaaatcaccttcttttaatttcattccacaaacaccttgggtacctctattagtaagcctaacatcccttgaattaaatataaatgcactaccctttttagaaagacaaattactttttcatccttaaaaacaatctctgcacttgtaacaaaatctttatcattcagtttaataacaataacacctcgtgactttactgctttaaaatctgtagattcgaatctagctatctttccacttgcagttgtaagcaataaataagcatcatcagttaaatctttactattcttaatagttaatatttcttcttgatctcctaaattaataagctcactaatattctgaccttttgaagctcttgaagaatcttttatttcataagcattgattaaataaagctttccttcatttgaaatcataaataaataatcatgagtattgacacacaaagcaataacaatctcatctccatcatttagatcaaacgaacttagtccttttcctcccgtaccttgcaatttatactcattttgtgaaagtcttttaaggaaacctttctttgtaagcataacaacaatattttctttttgcattaaatccgacatactagtttttaaaacctcctcatcataaattattttagttcgacgttcatcgccaaatttcaaacctaaattaatagtttcttctcttataatattaataatccttactggattcaagagaatatcttcataatcttttattaagcttaacagtatattaagctcctcttcaagcttaaaaatctcaagggctgtaagtttttgtaacctcatatcaagaactgaattggcctgaatctctgaaagaccaaaattcgaaacaagcctctcccttgcatcttttgctaatttagatgatttaataatcttaataacctcatctatattatttaaagcaatatttaatccctcaagaacatgtgctttctcttttgcctttctcaagtcaaattcaatacgtctttcgataatattttttctatgctcaataaattcaaataacaattcttctaaatttaactgtttgggaataccattaacaagggctaaattatttatactaaaatgctttttaaattcagtatattcataaagcaaattcataataacatgaggatcaaatcctcttttaacttcaagaactatcctaataccttctcgatcagattcatctcttatatctaaaagtccttctagcttttcttcttttgctaaaagcgcaactttcataagaagtgcagatttatttaccgtataaggtatttctgtaacaattatagcatttctatcttctgctctttcttcaatatgatatcttgccctaataacaacacttcccttgccagttttgtatgctttaattaaattatcattataaacaatctctccaaaagttgggaaatcaggccctttaactattttaagcaaatcaaatatagaagcattctcattatctagcatgtaaacaatggcatcacaaatttctcttaaattatgaggtgccatattagtagccattccaacagcaattccactagagccatttaccaaaagaaatggaaatgatgacggcataatctcaggctcacttaaagaatcgtcataattagacttaaaattaacagtctctttgtctatatccttaacaatatattcagttattttttccattttagcttcagtatatctcatagcagcggggggatctccgtcaatagatccaaaatttccctgtccccgtattacgggatatctaagcgaaaaatcctgagcaagtcttacaagagcatcataaattgattgatctccatgaggatgatatttcccaagaacatctcccactattctaccagcttttttaaaagccttatcagaacgaagtcccatctcatacatagaataaagtattctcctgtgaactggtttaagaccatctcttacgtctggaagagctctagaaacaataactgacattgcataatttaaataagaagtttttatttcatcttctatcctaacatttaatatttgttctttattttctccaactgccattaacgctccaattacacatcaagattaattacattaagtgcattctgttcaataaattcttttctgggctcaactaaatctcccataagagtaacaaaaattttttcagcttcaatagcatcatctatattcatcaatctcatttttcttctagcaggatccatagttgtttcccaaagctgcgttggattcatctccccaagccctttatatctctgaagagaaatactattgcgatttttagtttcaatagaatctaaaaatttttctttttctttctcttcataaaaataataaatacgattgtcatactttattttataaagaggaggcatggctatatatatatatccattttcaattaaatctctcatatatctaaagaaaaaagctaaaagcaaagttctaatatgagatccatcaacatcggcatctgccataataatgatcttgtgataacgaagttttgtaatatcaaaagttttaccaactcctgcaccaagagatgcaattatgggaataagcttatcattggtgataaccttatcttctcttgttttctcaacattaagcattttcccccacagtggcaaaatggcctgaaaaaatctatttctacccattttagcacttcctccagcagaatcaccttctacaatatagatttctctttccaaaggatttttagaagtacaatcagccaattttccaggcaatgccaagctttcaaatgcatttttttttctttctgattctcttgcttttcttgcagcttcacgagcacgagcagcttttattgcttttccaagaatagtgtctatctctaaaggatttaaattaataatttccaataaatgttcatatacaacaacttcaactatttttcttatctcagaattaccaagcttactttttgtttgaccttcaaattgaggttctggtactttgacagaaataacagctgtaagcccctctttaaaatcatctcctgtaagatttggaatatcttttttacttatttttgaatttttaaaagcttcattcatggccttagtaagtccacttctaaatcccataacatgagttcccccttctcttgtattaatgttattaacaaaagaaagaatgttgtcagaatagctttcagtccatttaagccccacattaacaataacatcattaataaaaccatcaatataataaggttctgattgaaaagctttgctgtcattagttaaataatctacaaaagattttatcccaccctcaaaataaaattttgaagatttttctttaccaattcttttatcttcaattgaaatgtatattttatcgtttaaaaaagcaagctctttaagccttttttcaagaacatcgaaattataatctaaagtttcaaaaatttcagaatccgccaaaaaagtaaccttagtccccgtaacagaagattcccccacaacttctactttagaagtcggaataccttttgaaaaagtttgcctaaaaatttttccatctctattaacataaacctctaaaaacgaagatagagcatttacaaccgaaattccaacgccatgaagtcccccagaaactttatacgtgcctttattaaacttaccaccagaatgtaattttgttaaaacaagttcaagggcactaataccctcctcttcatgaatatcggtaggaatacctctcccattatcaattacagttatagtattatctaaattgataataacatctattctatcacaaaacccagctaaagcctcatcaatgctattgtcaaccacctcataaaccaaatggtgcaatccattaatagaaactgagcctatatacatgccaggccttttcctaacagcctcaagtccttttaagacctgaatgttactagcaacataattcataaaccttccattcatttaattaaaatctagacacagataaattctacattaaaaaaaaaataatatctattacataggaaataccaaaaacttttaaaaattcacaaacaatttagatagaatcctaatttaacattatactatataatgttaaaagtatagtgctaaaaccaacaaggacaaaaaaatggaaaaatcaaaaaatatatggagcttgattttaacagaaataaaaaaagaactatcagaagaagaattttatgtttggtttgaaaatttgtgctttttagaatcaataggtgacaatattaaaatatctactccaaatttatttcataaaaatcaaatagaaaaaagatttacaaaaaaaattaaagaaatccttataaaaaatggctacaataacatagtcattgtatttacaaatcaaccacccaaaactcattctaacaaacaagaaactaaaaacccggctcttaacgaaactttttcaaagttcgacaagctcaaagaaaaaacaacttccaaagaagcaatccaaaatattcaagatcgtataaaaatgtatatcaaaaaagaagaagaagagcccacaaattttaaaaacccctttcttaaaaaaagatatacatttgaaaattttatcatcgggccaaataataaacttgcttacaatgccagcttgtcaatctcaaaaaatcctgggaaaaaatataatccgtgtttaatttatggtggagttggacttggaaaaacacatttgcttcaaagcataggaaacaaaacagaagaattacatcataaccttaaaatattatatgttactgctgaaaattttttaaatgaatttgtagaaagcataaagacacacgaaacaaaaaaatttaaaaaaaaatacagatacttagacatgctacttatagacgatatccacgacttacaaaaaaaagaaggtatacaagaagagctttttcacacatttaatgccctttatgaagacaataaacaactagtattcacatgtgaccgatctccttctgaacttacaaattttacagatcgattaaaaagcagattcacaaggggattaaatgttgatatatcaaagcccaattttgaactcagagcagctattgtcgaaaaaaaagcagaagaagatggcataaatgtccctaaaaatatactaaatctggttgctcaaaaagttacaaccaacgtaagagaccttgaagctgctgtaacaaaactaaaagcatatatagatttagacaatatagaaattgacattgaaattgttgaaaaaataatcaaagaaataataatttacgaaaaagaaacaaccaatgagccaaacaataaaattaatatcgaaaatataaaaaaaatactcttaagagagctaaaaatcacacacaaagatattgaggggcatagtaaaaaaccagagataacaaaagctagacatatttatgcgtaccttttgagaaattttacagagctatcaacagttgaaattggaaaaattattggagggaaaacccattcaacagtgctttattcgataaataaaatagatagagacagaaataatgacaaagaaattaacaatttaatcacagaacttatgaacaaaataaaaaaaaattaaacttaattgaagaatcaaaaattattttaaacaattgaaccaaataatttatcaaaaatacaacaaaaaaacaacctacaatttaacaagatatttacttgcatcatatagtattaaatacaattaaacaatcaaacagtagcttactactattactactatatatctataaaaaataaaaatacaaaatccacaaaatcttattaagataaaatgtaatagaatatataaggaggcatcatgctacacaacacattttttatttgcgaaacaaatcaaattatgaatgagatagaaaaagcaaagggaataatattaaacagaaatatgaatgatatttggagtgcattgttaatagaagtaaaaaaatctaatctcataatcaaatcaacagacagaaatatattttttgaaagcacaatttcaattgtttcagaaacagattttaaggtattaattaatgcttcaaatttttatgatgcagtaaaagcattcagtttttataagaaaatcaaaatagtttttaatgaaaataatagtaaattagaaattatgggagagttaaatgatgagaaagaggaatatgaagatcatttaaaagagcccactttttcatacgaagaaatagaaaattacaattatgatatggttaatgaagattatacttttggaattgaaataaaacaaaaatcttttaaaaaagtaataaatagaatagctttttcagcacatcttgatgaatctaagaatgtattaaatggtgtgtatttttcaaaagatgaagattctaaattactacttgtttctactaatggtcacagaatgtctatttgtaaaacagaagtcatagttgaagaagatgtgaattttatagttcctgtaaaaatatttaatttcttaaaacatcttatgtcgggagaaggtatggttaaaataaagttttcggataaaaaattttatgttgaatttgataattataaaatagcttgtagcttaattaatggtaattatccggattataaaagcattatacctaaagaacagaaaaataaatctttagtttcgctaggcattttaaaagatagacttgcaagagtcaatttatatgttgataaatcaagaaagttggttttaactttctctgagttacaattaaaacttcttggagaagatttgattactggaagaaaaggtgaatttttcattaaagatccaaattatctgtatgacggagcagatgaggttatggctattaatatttcatattttgttgaagctattagtgtttttgaaacttcaaagatagaaatacaatttaattcgggcaatgtattaaaattgagcgaacctgaaaattttaattttacgcacttgataatgccgatgtctttgggttaaagtgagttattaatgctattttgaatattaaaataagcttttctaggtttattcaatattgttttttgcattgtggtataaaaaattgatatgaatgattctgcttttaaaaaaataggcaatgttcttaaggattatttagaatccaatttgcttgttaataaaaaaataagttcgaaattattgattgccgataaatggaatcagatatttgaggctttatcagatgatgtaaagtttttagattttaaaaatgagcagatcctttttcttgaggtaagcaattcaagtattttgtgtagtatagcaatcaataagtcgaagataataaattcagtaaaagaattaacaggtattaaaataatagatataaaggttttggtaaggtaattattattgacaattgcatttatatgctataccatgttagtgtttaatttgtagcttggcagcataaaattgtttttaatggaggagcgttttgaaaagaacttatcaacccagtcgtgttaaaagaaatagaaaatttgggtttagagctagaatgaaaactaaaggcggaagacttattctttcaaggcgaagggcaaaaggaagaatgaaattaactgtttctgatgagaaaaagaaatattagtttaaaatcaaaaatagaaattcaaaaaattttcaaagaaggcaagctgattagatttagcaatcttaatcttaaaatgttctataaatcaaatcatttggtttattctagaattcttgttaccttttctaaaggctttaggggatctgttaaaaggaatcgcattagaagactttttaaagaagcttttagaaaaagattagaattgttagaagggattgctttagatattatttttgtagtttcttatggtaagttaactttgacttattttagcattgaatctctcatgaaaggtttggttttaaggtgtgaaaggggcataggtgaatcaaagtagaagaattttaagaacagtttatttgtctttatttttaataggtcttttcatgcttattaatgatattttttcttcaaacattttaagttctaagtcttctgataaggaagtgcagtttgatttaaacaaaagttttgatgataatgagatgtcttcagttaagagtaatagctttaatttgattaataaatctcaagatattattgtagagacagggatatatgttgctactttttctacatttaaaggaaatttggtttcattaaagcttaaaaatcatttaaatttggaaaaaaatcctacagatttgattaatattgatcgcaaaaatgaaactttttttgacattagttttgactattttgtagatgatttgtttttgtataaaaagatagatgattttaatcatgaatttaaagcttattttaaaaataatggtaaaacttatgaatatgtaaagaagtatacattttcgaaaaaagatgagtacttaatgcaattcaaagttactgtaaatggtcttgaggattataacttatttgattttgattcttataaaattatttttagttctgagattgaaaggttgagtgataaagcaaagctacaatataataattatttgtctcaaataatttattatgataataagcttaaatatggtaaagatggtctaaggattaacaatcccagatggattggttctagtactaagtattttggggtgttagtttcyaaagaaaatatggaggttgaatttaagaaggaaagaggaactcttaaatcgtttattattaataatgttagaaataaaaaaaatattagcgatgagttttttatttacgctggacctaaggataatagatatttagacgtttttgacaagagagatgacaatacctttggtttatttgatattttttttggaatgtcagtggaaaagagtttttggtatttgattcaagttcctatgcaaatggtaatgcaagttttttatgatgttatacctaattgggggctttcaattatttttttgacaattgttgttagaatacttatctttcctttgacatttaagggatttagagctactgcggarctttccaagcttcaacctaaaatgaaagagcttcaagcaaagtttaagcatgatcctaaaaagttaaatgaagagatgggaaggctttataaagaagaaggagttaatcctcttggggggtgtcttcctgtaattttgcagcttcctatattttttgctctttattcacttgtaaataatttatttttattaagaggagctagttttattccaggatggattgatgatttatctatcggtgacagtgtatatcattttggatataagctttattttgtttcttggaccgatattagaattttgccttttattatgatgtttactcaattgggatctacaattgttagttctaatatggatttaaaaaatcttggggcgcagcagaagtttttatattttggaatgcctattatgttttttttcatactttacaatatgccatcagggcttttaatatattggattacaacaaatatttttactattttgcagcaatactatataaagatgcatttgtcttaaagggggaataatatgagctatgaattttacggaaaaaccgagcaagaagcaataaagaaagcaatgagagatctagaattaaaagaaggcgagtttgatgtagaaattttagataaagaaagggttggatttttatttaagaaagaaatgattaaaatacgggtttctcctcatgcaaaggaggttaaaaaagacgattttgaaattaaaattggtgatgaaatttgtgataaaattttagaatttgtaaaagaaatgctaattaaaatgggatattctgtacatttgacaatagagcccaaagaagggggatatgttaagatttctattgaaacagatagtccaaatattttgattggacgagagggtaaaaatttagattctttgcagcttttaacaaatgtttatgcctctaagcttattggtgaaaatggggcttttaatagggttatattggatattggagattatagagaacggtttaaatctaggtttattaatttagcaataaattcttttcataaagtcaaaagaaccaggcgctctattttgttgccatcaatgaatccttttgaaagaaggattgttcatacaactttaaatcgttatagtgacataaaaactgaaagtgagggagatggaaatataaaaagaataagagtctcttatgttagaaataataggtatggtatcaacaattctcgtggttatcagaaaagagatattggttttaaaaaatagattaatgggcttgctttgtattgaattttaaagaggaataatagtatgaagatttttttaaccggaattgcagggtttattggatttcatgtagctaaaaagcttgtggaaaaagggcatgaagttttgggaatagacgtattaaatgattattatgaactcaaatttaagcatgaaaggttagaagctttagggttttgttctaaggatgttaaaacgcataagattattaagagtgaaaaatataataatttatcttttgcttatcttgatatactaaataaggataaactgctagaactttttaaagatcataagtttacacatgtttgccatttggctgctcaagcgggcattagagatagtcttgaaaatcctgatagctatgtttcaataaatattgttgggttttttaatgttttggatgtatgtagagtttataaagaaaacatcgagcattttgtttatgcatcaacgtcatcggtttatggcataaatgaaaatatgccgtctagtgaagattctattacggatcaccctttaaatttatatgcagctagtaaaaaatctaatgagatgatggcgcatgcttatagtgcatcttttaatattcccacaacagggcttagatttttcacagtttatgggacttatggaagacccgatatggctttatatttattttcagatggaattaaaaatggcaaggctattaatatttttaataatgggaatatggctagagattttacatatgtgggtgacattgcagacggtgtttacaaagttttgaaaaatccggctaagagtgattgtaattttgacgttaaaaatccaaattcatcaacttcttcttttccttacagaatatataatataggaactggacacgcaactaaactgctagattttattagcgagcttgaagcaaattttgataaaaaggccttaaaaaattatatgcctatgcaaaaagcagatgttgtagaaagttgttgtgatattttaaagcttaaaaatgatgttgggtatgaggctaaagtttctattaaagaaggaataaaagaattttcacagtggtataaaatgctagagtctaccaagaagacttgattttaaacttttttatgcaaaataataaatttttaataaattttatgtttggttttgatttaataattatttattttttgatttaaattcaattcaacttcttaggtgtataatttattataggcatttgataaaagaaaaaataaaatggaaaggagtgatataaatgggtgttttagataagattaaaccaggtgtagtttatgggaaggaactacattttttatatgaaatatgtaaaaaggaaggatttgctattccttctattaattgtataggaacaaattctattaatgcagttttggaggcagcaaaagaaattaattctcctattatgatacaattttctaatagtggatctgcttttatttctggaaaaggattaaagatggaaaaaccacaaggagtttcaatagttggagctatttctggtgctatgcatgttcatttaatggcagagcattatggtgttcctgttgttcttcatactgatcactgtgctaaaaatttgcttccttgggttgaaggccttttagaatatggagagaaatactatagtcagcacaaaaaaccattattttcttcacatatgttagatttatcagaagaacctattaaagaaaatattgaaatttctaaaaaattcttagaaagaatggcaaaaattgaaatgtttttggaaatagagcttggaattacgggtggggaagaggatggagttgacaattcagatagagctttgcatgaactattttctactcctgaggatatttattatggatattcagaacttttaaaagttagcccaaattttcagattgcagcagcttttggaaatgttcatggggtatataaaccggggaatgttaagcttactccaaaagttttaaaagatggtcaagattatgtcatatcaaaaacaggagtaaatatggctaagccagtttcttatgtttttcatggagggtctggatctacaattgatgagattaatgaggcgctttcttatggcgttgtaaagatgaatattgacacagatacacagtgggctgcctgggagggtgttttaaattattacaaaaaaaatgaaagtcgtttgcaaggtcaattaggagatggcaaggatattgatattccaaataagaaattttatgatccaagggtttggttaagagaagctgaagtttctatgaaagaccgtgtgaagattgcatgcaaaaatcttaataatattaatagaaattaaataaaaattcactaatttttatttgcaagctgctttttgagcggcttttttattattctaattatattttagatatttataaaattattgattgtttgatatagttttttactatttatcgggtatttttttgtttattttttcaaaacctgaataatagattaatttatttttaaaattattattaaatgctgtgtttatgagactgttttgattgaaaaagtaattaattaataagatttttttaaattttaaaaaagcattttgttttagattttgagacttaatttcttgaaagaatagcagtatcttgaaaaattccaaggaatgttgagtagctgatttttataattttaaaggtatatggcagagcttgcattatggattaattgtcaccatcaacaatattaattcccagttctttgagttgttcatttgagattttagagggggaattatcaagagggcttgctgcaaaagaatttttaggaaacagtattacatcttttattgaagttgattttgtcatcaacattattagtctatcaatgccaatagcaatgccaccatgattaggagctccatattctaatgcttttagaaaaaatccaaatctatcttctgatttttctttttgaaatcctattattttgaaaattctttgttgaagctctttgttatgtattctaattgaacctgagccaagttctacgccatttaaaacaagatcgtaaatttcacctatagttttttttggatttttttctaaattagcaatatattgctttttgggaagcgagaacatgtggtgagctggtgaataggtttttgtattttcgtcatattcaaatagtggaaaatcatagacccatagaaattcaaatttattttcatctattagtccaagatcatttgcaatttttattctaatttgacccattgctttacatgcagtttcccagttattattagctgtaaagaaaattatgtcattattttctaaagaataggtttttattaattcctgttcttctgtttttaaaaattttgcaattcccccggaaaatttattgttttcaatttttgtaaaataaagcccttgtgttttgtaaagctttgcaatttcttctaaattgtttatttttgctcttgaaaacttgtcagctttatcttttactattaaaattttaattgaacctttgttttttagagtatctttgaatatattaaattctgaattttttagattacgacttatatcttgtaattcaagttcaaatctagtatctggtttgtcgcttccatatttgttcattgcctttttgtatgttatttttttgaattttttaggtaggttaatattgatgcaatttttgaatattaaaaaaagcatattttctattaatttaaaaatattttcttttttgacaaagctcatttcaagatcgagctgggtgaactctggttgtctgtcccctcttgaatcttcgtctctatagcagcgggctatttgaaagtatttgtcaaatcctgctatcattatgagttgtttgtaaagttgtggagattgaggtagtgcataaaaagatcctttgtgaatccttgatgggattacaaaatctcttgcaccttctggcgttgattttacaaaagttggagtttctagctctaaaaattttctttttattaaaaaatttctaataagatgagtagcctgacatcttaaaataattttatttttcaaggaatctcttcttaaatctaagtatctgtattcaagttttgagttttcacttgcattattgtcatcttctatcataaatggcaattcattgcactttgagataatttcaatgttttttgccaatatttcaaaatgtcctgttttcatatttgcatttatcatgttggggggtcttttgatcaacagtccttgaattttaatgcaatattcaagttttattttttctgcgatctttagaagcttttcttcatttaccagaacttgagctttttcatatctgtctcttatatttagaaagataaattttccgtggtgtctaattttttttacccaagcatttatttcaacttttttgtctatcaatttttcattcaattcattacatttgataactttaaacataacttagctcactattatattataaatttctttatctgtttttgcatttaaaatttcttttttgtacagatcaactttgcccacaacagatgctaaaattctagggtagctaacgtaatcttttgctgggcacagtattaatataaaaacatgacttaagttcttgtcaagagcattaaagtcaattccctcatggcttattcctattgcaatatgtatttttgatattaaatttgtttttaaatggggaatggcaaagccttcttttagtgcagtagtaattaacttttctctttccattaaatcttggaatattctttctttatcaatttcaatgtttattacgcttagaagctctcttattacatcagccttattgcttgattttaattctagaataatgttttccttttttattcttttatttaggttgatattactaaggattttatcgtaatttattgagtaatctagtttttttgctcttaaagagactgtttcaacttctttggttattttttctaggtttaagattgtttctctaaaaagatcttgtattataattaaatgattatttgggcattcaaatgtgattttgctaccttctcgttttattgagaaggatatattgttttttcttgcattaatatattgtgaagaatcatttttaatttgttgtgtaaaaaatccttcttttcttaactcatttttaaagtcccatataagaattttggctaaattatcatattcaaatgatacgcatatgtgtgtattttgatctattgggagttcttttttaagtccacttttatttattttaaataaaaagtttattatgggtgttgcaatgattgttggcaaaaacaccattattattatgattccaaatattttttggctaataaatcctgaagataatgctacatttgccataataagtgaaacttctcctcttggaaccattccggttgcaatttttaaggctccaagtttattaaatcctaaaaagagtgctgggataaagcaaaatatacttttagtaattattgctattgcgctaattgctaatcctaaaataagaacttcctttgaaagtatttcattaatatctgacataagtccgattgatgtaaaaaagatcgggataaagaatctttcaaagattgttagtttgtcttgaattacgtatacaatgtctgtttttgacatagcaagtccaaatacataagccccaacaacaaaagacattcctaaattttggaaaatgcttgcaatagtaagggctagagagagcgttattacggttgctaaggtgacactgtttaattttttcaacagtcttgagagtgtttctgatatatatattaaagagaaagttaagcatagccaaattactatgttttgaactatagcttttattgagcttgctatatcaagatctgatatagatcttgatatagttattacacttgtaagcataagcattgaaagcacatcatcaataattgaagttgagattattgtcactccttctgaggtactcatttttttctttgccgagagtatgcttgctgcgattcctgctgatgttggggttccaattattccaataaaaagtgaggttgggcttattaggggaacgttaaaaattatgcttgccattagtacaaaacttgtgaaggttccaacaacctctgttattccaataattcctccgcgtggcaaaaatttgataaacaattttaagtcagtttcaagtcctgctgtgaaaagcaatattattgaagctatggtagagattgcaaatattttttcatttattaaataattttctccaatttgagttattcccaatgggaataataaaggtatttgaatttttccaaaggcattcggacttagaattattcccgctgttatttgccctattacttttggaattcctattttagctactagattgcctattgaaatagatgagattacgatgattgccagactcatgacaaaagccgacatttttacttcaatgtcgtattttgttgagtatgaaaatagaagattaggtaagtgcagcagtattgttatgtaaaaaatttttttgttcatttttaaagctcttttgaaaaattatattttagcaagtttaataaatttttaattgctagtttttctttttttccaacgactgttatttttattttttctttgtatattatacccaatatgataatttctattgtggactttgcgtcagcttttctgccatcttttgttgttatttttatgtcgcacgaagaatgtttatttgcgaattcagcaatgatgtttgccgaccttgaatgtattccatctttatttattatctcaatttctacttcttgcattttttacttatcttatttgttgttttttttctctttctctttggttgctgttttgtaaagtcttgctattgcactatcaataagattaagaagtattttcccatcttctcttatatgtattattttcccccaattaaagtgaatatgtgcgtctaatttaaaaagttcatgttcttttttaattgtaatttttaaattatcaatatgttttttgatatgagtatcaaatttttctagctttttgagaataaaatttttttcattctcattcaagctgtaattaaccgtttgaattttaggttccataatatgttctccctttctcagattttaattcatttctgtatttatttactgttcttctagaaatagagattcctttggactttagtataacagaaatctctttgtctgacatctttttatttgcttctaataacttttttactgttattttgatgcttaattttgaaaattcatttgtttttgctccaccaacagagctaaaaagctctttgattaatattgtaccccattcgcattttaagtatttattttttattgctcttgatattgttgattttgatacactaattttttctgataaaatgctcaagttcattggccttaagcttttaaatcctcttcttagaaattctttttgcaatgtatatatagctattcctatttttgcaagtatttcgtctctatatcgtagggattcgattaaccactttgcttttttttgtttttgggggttttcacttgtccttttaagttcttttttaaagatattaacttctttgattttaattttaaatttattattgtgatttattattaatatatctggatcaacataaaaattagtgtcgtttgggtctttaaattcgagcgttgggttggggttaagtttttgtctgataatttctaaagccgtgttaaattctttgcttcttattttaagttcctcttttaactttttttgagttttttcaagaagctctgctttttcaagaattttaataatattagtttctaatttatgatgctttgcttgcaaaattaacgattctattatgttggggacacaaattccaattggatcaaatttttgaataagttcaattattttttttactttttctttttcttcctttttaaaaagatcgtaagggtttattatatgaaaacctttgctgtttagattgtttatgagtatttcgcctattttaatttcatcttcatttattctttgaattcttaattgcagtaaaaggtgttcttttaaagaagtatttgtttgtgttttttcaagagctatgtcgtgttgattttttatcatatcatcttctttataaaaaacttttttaaacctatatgttttcaatgtttcaaaaaatattttatttgagtttatttctagacattcattattttcgctttcttctagtataagctttgttaattctttttggttaaggcttaatatttttattgtttgtatttgaattgagtttaaattttgagatatttttaatttttgtttaatcatatttatattaatgtataaaaaaatccactaagtataattactaatgctggacttattttattataaaaaaataaaataaaaaaattaattcctacaatagccagagttttcaaaagttctgttttgttgttttctatttttaaatatgtattttcaagcaaaatgattattgtaattatccacagcgcaacaataataggttttagattttctaggcaataatttaaaaagccgattttatgtagtattaggaggattataatcattattattattggggctgttattaatgctactgtagcaattattgctcccgcaattcctgcagttttcattccaacgtatgttgctatgtttgttgcaataggcccaggggttattcttgatattgtaatcatattgacaaattcttcttttgttatccaatgtttattattaattatttcgttgtttattattgctgcaattccattaccgcctccgaaatttaataatccgatttttaagaatgtaatgaataaatttattaaaatcaaccgatatcctttttctatttagttaatattttttttattgttatatatttaaatgtgtatactaaaaagaaaattaacaatatgtatgatatttttatttttaatttaaaaattgcaaaaattacaagaaaacatattgtccattttattatagaatcatttagcatttttttggaaaattttaaaacaacggttatcattatgataattgaagatatttttgcaccttcgagaaattttttaacatgtatgctatctggtactaattttagataaaggaaaaccattattattgcaataatggaaggcaaaattcctgcaacaacgagcaaaagtgcgcatggaaaacctccaaattttcttcctactaggaacacaaaattaatcgctgtaactccaggaataacatttgatgttgctagtattttgttaaaatcgtcctcagatattatttttctttttttaacaaatatttttttaagctcagatataattattaatcctccgccaattgtaagtgttgttgttttaaagacaagtaaaaacaagtccagaatttcatatatttttttttgtttctttttatacatttgttttgtcaaatttagtaaaaacctttggatactaattttatcacaaatattgttgtaatgttcattttgttgttgagcggcagtaatgaaaatatgctttattgtgtctttaaaatattgagtcattgttttaattagggtttttattggaaggcttgtttgttttttgtgctataattcaattaatttatgtaaagcccggaaggaaagtttaatttgtttaaggagttttttatatttcaagattattttaattatattattgagggcgtggtaggttatggtctaaaagtttcgattgctatagtgctatggtattttttaaagttaatagttagtaaaatgggaaaaattttatttaaaactttagaaaagtccagattagaggaaaagttagaagttacagtttttaactttttaaaatctttttttaaaatattaacagactttgttattgttttaataatattgccatatcttggggtgcctacaacatctattattgctgtatttggatcattagggcttgccattgggcttgctgctcagaatattctatctaattttgttagtggatttattgttttgaattctaagttttttaagtgtggagatcatattcaatgtggagatgttgaaggtttggttgcagatgtccaaattttttttactacacttgaaacatttaacaaagaaattattaaaattccaaacagtaagcttacatccaattttgttgttaatttttcgtcatgtactagaagaagagttgtgttttcttttcaagttccctatgatacgaatattggtttattaaaggataaaatagaggatttaatgattttcaataataagaaatttaatgttgagctttgtgctcctactcttattgttaaaaaatacactccttattatatagttttgcaagttcgattttttgttaatacagaggttttttgggattttcaatattttgttggtgagtctattcaaaatgttttattggatatgaaaattaaggttccaatttgttttgtgccttttgataagctgtattaatgattttttcttgcaataatttctgagtaatagtttttaattttttttgtgaaaaaatagcttgaaaatttagtggagtgtttttttgcattttctttaaatttttttagtatttcatcatcttttattactttgtctatgtaccgagataagttttcatatttttttattaagaatccgtttatcccctcttttattacgtctttatatatataatcatttattaaaatagcaggtattcccgcggttaatgcttctattactgtcattggatatacttcgctttttgataggctagcaaagatatcagaaattttgtagtaatagtatatttcttcccatggaattgttcctattagcaatatttgtttttcaagcccatgtttgatgctaaaattttttatttccttttcttcacttcctttaccaataagtataagcttataattattgttttgcattaaaagatcttttaagtgtgttactaataaatttatatttttttctttatttattcttccaacaaatattattattttgtctgtttgctttatattgtgctttttcaaaatttcatcttttttttctttgcttagagtttttataaaaagctttctatcaaccccatttggaattattttatagttagaagaattatttgaaagttggaaatatctctcttttgctttacttgatgggtaaataaaatgttttattttattataatgttttcgcatcattttgtcgggtttgataaaatatttaaaaattcctaagtaatgcaaataataatcccacattgtatggcttgtatgaactattggtatgttgtgttttaatgcaatttgttttccaatttttcccatagaaaattcagagtgagtatgaatgatgtctggtttatagctttgtattattttggatatttttcttttattgggaaaagctattacagcatcaagttttttatttatttgaatagatgagcatctgtaaacgtttttttcgtttaaagattttttggattttgggcaaaatatgtaaacctcatagccatttttttcaaatccctctttaatttgttttattgatgttgctactccatttttttctgggatatatgtatctgtaaatattgcgactttcatattctcctcctagcttaagtataatatatttgctacttggattataatttactttaatgcaagcggtttatttattgttgggtaatgagcaaggtttaaaagaagcctatttaaaagagcttttaattaaaatggatgcttttaaatccgaagtttcagttactaaaatttttttgtcagaactctcagctgtaggatttgctgagaaattattttccaattcttttttttcaaaaaaagaaatttttattgtttatgagtctgaacttttaaaagcaggaaaagatttagagctagtgtgtaattcaatcttaaagtctaacaataaaactgttatttttgtttccaatagcaatacatgtaacattgattttaagaataagcttaagtttataaaaaaagttttttatgagattcctgatgatgataaatttacatttgtaaaaagaaatttttttaatcttaatattaaaattacagattctgcaataaatttaatgcttttaatgttaaattcagatactaaaattttgaaattttatatagattcttttgcgctttttgccaagaataataccattgaggaggaagatatagcttcttggattagttttattcgctttgagaacaccttttccttatttaattcaattttgagaaaagatatgactcagtctttgatcaagattaagtctattttggatcagggagaagatttgcttaatattttaatgagtcttatttggcaatttaaaagattattaaaggtgcaaatagattataatgcatatgggagcttgcagagtgcattgaataaaaataaaatctttttttcattaaataaaatttatagagtaggaattaaaaattattcaattccagaaattaaaattgttttgaaaattttatataagtttgatttatatttgagaatttattctaaaaatattcatcaaaatttgtcatattttttaatattctcaattttaaagcttaataataattttttaatgcattattctacagaatcaaaatttaatttttaatgtatgaagcaaaaattaagttggattttattattttgttttttgtcttgtagatctgaatctagattggctgaaaatgttttaatagagttttttgattctattaaaaattttcaaagcagtcctgaaatattttttaattatttaaatattccaagtgatgatgatctgaaggcaaaaattcgtgggttgaaatctcaggcaaaggatgatttcattttttatcctttgttttttaataatctaagatatgagataataggtagaaaaaatatttctaagggctttgaatttgaagttgttattaaaaatattaactttcaaaacggtatagaaaaatttttggctaaattaaataaaattgaagggagatctttaaatattaaaaatttagaaaaaaaagagcgtaaaaaaatatttgacaatttaataaatgaagttattggagagttggatgattttgattacactgaagttgttcatttttttagagtagttaagagttcttctgaaagttataaaatagagcttttaggagatgttttaaatatacagtctagaaataagcttattaatgatctttttttggttttatcgcctggaatttaaaatagtgttttattttaaaaaatattaataaataataatctagtttaaaatttatttatcttgattattattttttatggagttctcttttattgcaaattcttttattctttttgcaagttgcacgtttacttttattttttctgaaatttcgttttcacttaaaggcaatatatctttataggttccaattgattttaatattttttgggctgttttttctccaattccgtgtatttttgtatacaatagggttattttttctcttctttttttgttaaatccgttggcctttctgtgtgcttcgtctcttacattttgcagtattctaagagcaggatgtccttggggtagatttattccttttttgttagttgttaagaatattgtttcttgtttttttgccaacgagcagactttaactttgttttctatttttaagccctttaagatagaaagagcggcatttaattgtcctttgcccccgtcaattaaaattaaattcggtagttctaagttgttattaattatttctgaatatcttcttgatattacttcttttattgccttaaagtcgtcaatttctccttttaatagtgaatttagtttgtaaagcctgtagttttctttaaaaggcattcccattttaaaagtaaccatagaagctactgtttcttgacctttaagatgagcaatgtcaaatccttcaattattttgggaagtttgtccatttctaaaacaattttcaaactttcaagtgctttggtgcttttattctcatattctcttaaagataattcagcattagatatggccatttccattatttttaaaatttcttctgtttctttgtaaataatttctgtttttgtatttttaatttcatttattagtttttcaacatttttagtgtcgatatctttgagaaaaatatgaattttgtctggtactatcatattaatagatgtgtaatattgaatcaaaaattgtaaaatcagctcattttctttgcatatactctcatcaaagtttgcatctctttcaactaattttccatttctatattttaatactattattgtatttacattttctcctggatgaacatggacataatctatgtttaaattattggtttttgtaacgatttggatttgattaatttctattaaagaatttctaatttcttttaatttgatagcggtttcaaaatcttctttttgtatggcatgttttaatttgatatcaatttgacttgatatttcggatatatttccatttagtatggattttgccttatctagctctttttgatattctttttcaaggttttccttgtagcatactccaaggcactgtcccatatggtaatataggcaaggagcattggatttttttttacactttctaatcttaaatgttttgttaataaaatctagtacttgatctaatttttttacattggtaaatggtccaaaatattcgcttttgtcattaattatttttctggttttgaaaattcttggatatttttcatgggttattctcaccatggggtaaccttttccatcttttaattttacattgtaatcaggtttgtgggttttaattagattgcactctagaagcaatgcttcgtattcgctatttgttgtaataacttctattgattttacatttttcattaatattttgattttgtgactatttttttctaaaaaataactttttactcttgatcttagattttttgcttttccaatatagagtatttttttattttcatttagcatcttatagcaaccgcttgtggttggtaattttattactttttcgaataaatttgttaggttctctttcataatgttaggcagtttttagattttaaaaatcatcttatgatataatattgtatcataaggcagtttgttttatgttttgaggtatttaaaaatatgggtaataacaaataaaaggtcaaaaatgagattaattttaatgctcttgctaycttttttgtgcttttctactctgttatctcaagaattgaagttgatacttgattcgaaaaaaaattttaaatttattcaagattttagcaatgttacttttgaaagggatatgaggggtttgcttggtatttatttggatagatataaagctgttttagatttgaataatattgatttgcgcttagaaataggaagggataataaattaaaagacacatcttcaaattatttagttagtgcaaaaagtttgagagtttcaaatgaatttcgtaatgtttctaatggctctttaattttttattcaaatcaaaatcctgttaagtttaagccacttacaaagaaagcgttctttttttcaggcaatactgtgtctgattttactattaagttttgggtatatcgaacaacgtctgttacaggagaaattatttttagttgggatggttataaaaagattaataattcgtgggtagatcagtctattagattagaaagcgatgagggaaattttgtttgggttttaaacaatgtatttttaaaagacaataaaaatcctatcaaaattagaatgaaaagtaatgatgattttattccaaagaaatggcatttgcatactttaagatataggcaaaaggacggcatacttgaatatttgatagattctaaacctcaggcaatagaatatataacagatgataagaaggaaggatcaggatatttattaagtattggtaattttattgattttaccttaggaacttattttactggtgcggttgagaatttggaaatacataaaagctttgaagaggttagtagtgcttttttctcaaagaatatgggatacattattacagagcctattaagctttctaaatattattctcaagtgttatcctttgatgttgattctaatgttcctaaggatacagagattgtttattattacagattagataataaggtattttatgatacagatagtcatgggaatattaaaaaaaatttaactggggcatggattcattttgatcctaaaaaagattttccagattcaaagatatcaaaatatattcaaataaaagttgaattttatcctagtggagattctgtaagtagtccttctctttatagtatgtcaattacttacgttcctgaagcagctccatttcctcctgtgataacaaaagttattccaggttccagagaagtttttattgaatggattcctgttgttaatagcagtgttgaggggtattacatttatattggtgttgtttctggtaattatcatggaaaaaccggcggcggtgttttaacttctcctattgatgttggaaatcaaacttcttttaagattacaggacttgaagacggaagactttactatattagtattgccgcttacaatttggataaaagtgttaataagacttctttttcaaaggaaatttctgtaaggcctatggagatttttaaaaaatatgaataactttagttttgagaaggctttaaatttttataaaaatggtgattttaaaagctctcttgataatttagatgtttttgatgagaattttgattctcttgcacttaaagcgcttatttatttcaagaaaaaggattataaggctcttttatatgttttaaatacttatcctgttgttttgagcgaatataattttttagttaaacttatagattatggcaaaattgaaaaaaataaagatgatttaggtccttttgagaattataatttaggtgttttttattttaatttaaaagaatataaacttgctttaagttgttttttaaaagctaaagagcaaaaatctgattttgtacaagctttaaacaatagtgctgtcttattcgaaatgttggataacaaagacgaggctttaaaattattttttgaggctagagatttggatcaaaacaattctctagttaagcttaatatttggattttaaaaaatagtgcatctcttcaagcagcaagctttttaaaagtagataaaattttttttgatgccaatcttgctcttgttgttaattatttaatgtattatttttattctattggggaaataagcagagcaattaggctttctgagaaatttttaacagactctcattattctaaatatatttggcacaatagggcaactatttttcataaaataggcaacatgactcaagccacaacatcttatgttaaagctattttaaattttcctaatatttatacgatctacaatatgcatattgcaacagttgagcttttaaaattttctcctaaaaagtctattgagagaatggttaatgattattctaacttagatttgatatatttatatgcaaccttattttttcttagaaatcgtgatcttgaggatgcctatttttatatgaaaaaactttgtgagcttaatccagagccttattcaaaatttttaaaattgcttgagtccagcgaggatatgttaattgaaactctgcttgaagaatttgcagtatctttaagagtaaattggtatttagagtatttattttttattgacaattctttaaatttgagagatcctatttttgtttttgatcacaatataagagtaaatacgtatatttggagaattaaagatgagtgcattgaattaaaatttagcaacaatgaggaaaaaatggttcaagaaatcttgcatgaagaatgtattttgcccgaaattgacatttctattggggattttcaaaatttaatagaagcttataaagagtttagaataaattactaataatttataatttatttggttgacaataataatatctctaagataatatgtattaatgttataggagagatgccagagtggccgaatggggcttcctgctaagaagttgtccttttaaaaggggaccatgggttcgaatcccattctctccgtaattatttaaatattgacagcgtgtattttatttattaaaatttgttttaactctggagaggtggcagagtggtttaatgctacggtcttgaaaaccgttgtaggtgtaagcctaccgtgagttcgaatctcaccctctccgtaattatcatttaattttaagtattaagattaagactgagagtgaaggtttttgtttggttgatattcattttctgtgttttcatgtatggggaattgaaactcaattttatcgcagccattacaatcatttgagaatggattataaaaaactataatttggttatttttaaaataatatttatatcttggaaagattgttgtgaattttttttccaattctttttgactgtgttttcctttaacataaaaatctttaattctactatttagctgttcttttaatacgtttattagagagtctagctgatcttttgatattatttctgaaatttctatttttttgtttccttttaggtttaaagaataatatttcaagaaagtgcttgattctttttctctgaaagattctttgtataaaatagatgtaatgccaatattttcatttttaaatattgtaaaattggaaaaataaaaatattcattttttgagttttcggggtttgatattttattttcgatgtcttttttccatttttttataagattttcaaattcaaagtttgcattttccataaaaggaatttttgcatctatatggagaatattattgttttgcagtatttcattttctttgatatttttagttttaatttcaaattcggaattaactttacttgagactgatttagagcatgatagaatagataatattgaaagaaaaatgattattctagttttcacaatttctccattttctattgaatgtttttattgtaataaatagtaatttttattacaataaaaactaattatttgtgtccatagctcagttggatagagcgttagattgcgattcttaaggtcggaggttcaagtcctcttggacacgaaaagtttgttagtttggagagatggccgagtggcttaaggcgcacgcttggaaagcgtgtatacagtaaaatgtatcatgggttcgaatcccattctctccgattcctaggacccgtactatcaagtattgctgaatcccgtcaggactggaaggtagcagcggtaagcgatttttttgatgagtacgtaagtcttaggtttaattttgaacccaaatgcaatgttttgctttatgttaagatatggatttgtctttttgtaactttcaattttattatattttttatgtttcataaaattcttttaaagtaatagctctgagatataaatatgttgtatagtatatatttactaatattttacttattaaagcatagggaggtaaaaagttaatggcgtcttcaagaggcactgctcttaagaaacgccccagagatttcaactctcttgaagggcaagactttgttgttgaaactctaaagcattctatagagaaaaataaaatagctaatgcttatatcttttcagggccaagaggcgttggtaaaacttcatcagccagggcttttgccagatgcttaaattgcaggaatggtccaacagttatgccatgtggggagtgcagcaattgtaaatctattgagaatgatagcagccttgatgttgttgaaattgatggtgcctcaaacacttcggttcaagatattaggcaaattaaagaagagataatgtttcctcctgcaatttctaaatatagaatatatattattgacgaagttcatatgctttccaattctgcttttaatgctcttttaaagacaattgaagagcctccaaattatattgtttttatttttgccactacagagtcacacaagcttccagagacaataaaaagcagatgtcaacattttagttttaaacttttatctttagataagatttacaatatgcttaagaaagtttgtttagaggatgatattaaatatgaagatgaagctttaaaatggattgcatataaaagtagtggtagcgtaagagatgcttatactctttttgatcagatagtttcttttactgattctaacattaaattagatcaaataagatccaagatgggcttaaccaatgatgaatttttagaaaagttgtcagttagcattcttggtgaagatgtgaaagagttaatttgtgttcttgattctatttttttatctggagtgtcttatgagcaatttcttttagattcaatcgaattttttagagaggcattatttttaaagataggtattaaaaattttgagtttattggaattaaatctgaggatttgagaaagaaattaattgagtttgatttgaactatcttgaaagaattattgttgttttgcttgaaacttacagggatttgcaattttcggttaatccaagatatgagcttgagattaattttattaaaattttaagacttaaaagttatgttccaaatcatgttttaataaagcaaattcaaaatcttgaagacaatctgttagaaaatattgctacagattcaaacaattttgatgttttatcaaataataagagcgaagatgatttggcttttattccatcaaaatctagtttaaaatgtgaatttcccgaaatcaaatctttagaaaaagaggaggctgatcgtgatgaaaatttatcaacaaaaattgataaaaatattttagagaccaatagtattgacgagattgatgagatttttattgaagatgataatgcgagtaattcaaatgattttattgatataagagataaatttatttatattgtttcaagatatgttcaaactttagttcattcgggagaggttgctattgatgacaatgttctttattataaggtgtttagtgagtttgaatataatgagcttcaaaattataaaggtgagataagatctgaattttacaaagaattccccaatttaagcattgtgtttcagaaaaattttaaaaaccttgaaaaggattttgaaaaactagaaactgtaaaaaatatttttggagcaagtgaagttctggagggataaaaatatggcagtaaatccgttagattttttgaaaaatatgtctagcgttaagaataatattgacaatattaaaaaggaaatttctaaaattacggtttgtggtaaagcaggtagcaatattgttactattgagatggatggcgaatttaatgttaaaaaagtttcaatcaataaggaattttttgatgatttagacaatgatgcttttgaacaaatgattaaatctgctttaaatgatgctgtctctaaggttaaagaagagataaaattaaaaaccatgggagttcttccttttggaatgtagtttttaattttgtaaaagttatattttgatttttcaatacaatgttaagtgctttataatttgtattattccatataaatgtaattaatcagatataatttttgtattgaataagtatttttatttatttaattatttttaaatatatatcctaaattttaggaggatttatgtcaatgttattgcaaaaaactttatgtattgttaagccagatggagttaggagaggtttaattggcgatgtagtttctagatttgaaagagtaggtttaaagatggtagctgctaaaatgcttattgttgatgagagtttggcaaaaaaacattatttatatgatgatattgtctttagacatagtgaggctgtttggaattctttaattaaatttatttcaaattcccctgtttttacatttgttgttgaaggggttgaaagcattgaggttgtgaggaagctttgtggtgctactgagccaaaattggctattcctggaacaatacggggagatttttcttatcatagttttaagtattcaaatgaaaaaggtttttcaatttacaatgtgattcatgcatctgcaaatgaggcagatgcgatgcgcgaaataccaatttggtttaaagacaatgaaattttaaactataaaagagatgatgaatgtgagcattattattgttaatttttataagtctatctcttaaaaggaataagttgtaaattacccttatgttattctgaaataagagcaatttttgtacttttgtttgaatttttgcattttaggagaattcttgtatagaagattgttcttaagagcagtgtttttaccttgattttgtgttttacattataattggttatgtaaataaattttatttgataaagtttttaatgttgtgttgttatgttttatagattgtcaattgaaatagaaaaaatttttagtcttgtgaaaaatatttatgaaaatacttagactttgtttgttgtttttgttttttgcttgtacttttgattatgatgagtattctagtagatctgatgtggccaaaaagtttccttcaatacaaatattaggaatcaagtattatgatgttgtatacaataaagagcaaaccgttttaaattctttaagctttagttatttcaatgactataaaatttataaggcagagaatggaaggtttttatatcattccctagataatgaaatttcagggaagtttaataatttggaaggttcttatattacaaaggatttggatatgagagattctgtagaatttaaaatagaagataaaaataattattatttgcttaattcaaataggcttttatggaagaataaagacaagaagttgcaatcccccccaaatgagctagtattaattagatttaatgatagcaaaataaacggaaaaggattttcttattttttaaagagcaatgttttttattttgattctggagttgaaggaatcatgaattgagggatttaattttaatatggatttttattatttttattaacaatattcaagcaacacaaatagaatccagccttaaatctgaaaggattaagggaagtgatgagaaaagcactaattttacttttaagtcagattttgcacaaggagtagtgtcttctttttataaaaaaattgttttaaaagggaattcagaggttatttcctcggattttaatcttagagcagatgaaattgaaatttatggagaaaatggctcttatcttgaagctagaggcaatgttttttataaagattataagaataaaatgaatgttaaagctcagtttttgttttttaatagaaagctggataatttttatcttcaaaaaggggttgagcttgaagacttagaaaacaatatgcttgttaaagcagaaagaattgaaggcagcaataaaactaatgtttatattatgcaatattctgttaaaatatataaggatgatacttttgcaagagctgaaaatgggacttataataaagaagaaaaagaaatgattcttgagggggttccagtaatttaccagaaagacaactattattctgcttcaagaataattttcaatacaaaaactaataggtataaacttgagggaagtgttgagggagaatttactcaagttgaaaatgatgcttctgaagaaaaaaaataaaataaaagagattaaggaaagccttaaccttgattctgtcaataatgttgtcttaaaagcagacaacattattaaaaagtatggcgaaaagcttgctgttaacggtattacaattaacatttataaaggtgaggttgtggggcttcttggtccaaatggagctggcaaaacaacaacattttatactattgtaggttttattaagcctaatgcaggcaaagttttaataaatgattataacatttcatctcttaatatgtatgagcgtgcacgaataggaattgtatatcttccccaagatgcttcaatttttagagaacttacagttgaagagaatatcatggttgctttagagagaagagaagatctatctaaagctgagcgcaaaatagagcttgtgaatttgcttaaagaatttgagataaaaagaatacaaagccaaaaagcgtatactctttctggtggagagagaaggcgagcagagatagcaagagctttggctgtaaatccttattttttactcttagatgaaccttttgctggtattgatcctattgcgattggggatataaagaatataataaaaattttaaaagagaaaaacataggagttcttattaccgatcataatgtaagagatgcttttgatataatagacagagcttatattgtttatcaggggcaagtgcttgatgagggtgatgttgattatataataagcagtgaaaaagccaaaaagctttatttgggagaagaatttagattatgaaaacaatagagcacgaactttattatgaatttaggatagctgatgatgttaaaatgatttatactaaaaagccttttaatctaaaattaaaagaacttagtaatgataattttaactttgttcctaggtctaagaaaataaaatatttaaagcaattgcatacagatattatttataaagttgaagatgattttattaattttcaagaaggagatggtcttatatctagctctttagatgtagcccttgttgcttactttgcagattgtcttccaatatacttttatgattcggtgaaaaaaattatagggcttattcacagtggatacaaaggaagctttaatttgattattttaaaaatgttatttatgtttgaaaaaatgggatcagctttgaaggatttgaaaattgtttttgggccttataacagatcttgttgttatgaagtttctgaaattttcttaaaagaagtaagtaataaatttagcaaagatttattaaatgcttcttttgttacaagagatggtaaaatatactttgataatgctagttttaatttaaatttactttctagttttaatttaaatatttataattcaaagctttgtacgtattgtttgaaaaatctttattcttatagaagattaagagaaagtcaaagttatgctttaatttggagaatttaatttgaatgtaagagatttgtcttttaagcttaattcaatttttgatataaataagtatgagcatattgataaaaatttaaatgggcttcaagtggggaatattaatgctaaggttaacaaggttgcctttgctgttgatgctagcttttcaactttaaaagaagcaaaaggaaatgattttttaattactcatcacggtattttttggtcaaaaaaagagcgcattgtttctaatatgtatgataaaacgaaatttttaattgaaaataatttagctctttattcggtgcacttgcctatggatgctcattctgtttattcgcacagcaaagtgttctcagattttttaggattaaaaaattcttttgcttttgcaaattatggcggagttaatctagggattattgctgattctgtttttagcttttctgaaattttagaaaaaatcaaaaaggaaaataaacatattcttttttcgaaaaagttcaaagaatcggtgaataaggttgcaattgttagtggttctggatactctttttttgaagaagctttatgtcatgatgtagatttgtttataaccggcgacacttctcatcaaatatattctttggcagaagaattcggtgtgaatttgatttttgcaggtcattattttactgaaacttttggtttaattaaattaatggaagatttcaaaattcaagaagatttagaggttaaatttatttgtaaaaatactaatttataaggatttttgtatgagcgctaaaagtaagcaatatttcaatatttttgtatttattattagtttgattttttttgatcaactttctaagtatttggttgcaaagtatgttaaattaggttcaatatatttttccttttttgatgatttttttaggataatacatgtaagaaacacaggtattttattttctatgggctctaatatccattatagcttgaaaaaaattttttttcttgcaatgcctattttcattttaatatttgttttttatctttctttgaaagaaagaaattgtattgccagaatttcacttttattaattttttcaggaggagtaggaaatgttattgatagattgtttagaccttctggagttgtagattttttagatttgaaattttatggaatttttggacttgatagatggcctacttttaattttgcagatagctatgttgttataggtatgattttatttttggtttatgatttttttataaaaagaaaagtgcttaataaatgaagattttgagttttattttatgtatgttaatgaacttatcattaatgtttctagttttctttttagagttttttttagttgttaaatttagcattattgtaaagccctatttgcaatttatattgatttttatgatgattgttttcgctgttttggtggggtattttgtgtcaatttttattgtaaaaagtttacttattaagttgtttgaactagatcaataaaaagagaggctttgtgtctttaaggattttaattactggcgaggttgtcggcaaagctgggattattgttataaaatcttttttatcatcctttaaggtggaaaaaaagattgattttgtaatatctggcaataattttactacaggtttaagaggtcttggcaaaaagcatgcctttttattaaaaaagtatggaattgatgttttaactttaggtgaaaatgcttttgcaaggcctgatttatctgatgatcttgataagtataattttattttaaagcctttaaattgtcctgcaaaattaaagggatattcttattttatttataatattaatggcaaaaaattggctgtgattagaattgtaggtcaaacaggaataactaaatataaatttaatcatcctttttatagttttgattttttttatcaaagaatcaagatgcaaacaaataatattattgttctttttgattcaaatactacagccgaagttaatgctttgtttttttatctaaaatcaagagttagtgcttgtcttggaaccgggaaaaggattttaacagctgatttgagaattttagataatactgctattataactgatttgggcagagttgggagtttggacagtgttattggatattctcctgatttagaggtggataaatttttgaaaggatttttaaatcagaaatttaatgaatcttgggaaggccttggttttaacggtgttttaattgatatcgatgagaatggccattctttttctgtagagattgttagagaatatatagattgtaaatcaagtttaaaagatatggatattgtttgatattcatatctttagatattctttaaattttaataatcttatctgtgcgatttaattttattaagtttttatatataggaggatggattatgcatagttatattgtagaaggcggctataagataggtggtcaaattacagctagtgggaataagaacgctgctttaccctgtattttggctgctttacttaccgatgaagaggttattttagaaaatattcctaatattaatgatgtaaaagttgttttagatattttaaatgacataggagcagatattgcaagagagggaaatactttaaaaataaaagttttaaatattgtgaaaacagaaatagattcttcttttacagatttaattagggcttccatacttttattagggccttttgtttctaggtttggaaaaatagatatggcgcttccaggaggagatgtgattggaaagaggaggcttgatactcatttttacgggctttgcaagctgggggccaagttaagcacaaaagatagaaggattgttttaaaggctaacaagcttgttggcgctgaaatgtttttagatgaagcttctgttacagccacagaaaatatcattatggctgcagttcttgctgaaggaaatactgttattatgaacgctgcttgtgagccacatgttcaagatttgtgtaatatgttaaattcaatgggcgctaatattttaggaattggttcaaatgttttagaaataaaaggtgtaaaaaaattaagtgggaccgtatttagaataggagccgatttcatgcaagttggttctttaattagccttgctgcattaacagggggtgagttggaaattaaaaaagcagatccccaacatttcagattaattaggcatgtatattcaagacttggcattaattttgaatatgacagggaaaatgtatatgtaagaaataaacaagaattaaaagttaagttagattttggtgggcacattccaaaaattgatgatggcccatggccagcctttccaacagaccttatgagtattattgtagttactgcaacgcaagtagaaggcacagttttagtttttgagaagatgtttgaatctaggatgttttttgtagataaattaataaaaatgggtgctcgaattgtgctttgtgatccacaccgcgtagtagttacgggcaaatcttctcttaaaggcaatgttttgtcttctccggatgtacgagcgggaatgtctcttcttattgctgcttttgttgctgaaggtcgcagcgagattcaaaatgtttatcaaattgaaagaggatacgaagatgtagttaacaaattgattaatttgggtgcaaaaatcaagaaagttaaaagtcaatagcttgttgttgggctttattatatgtatgatttgtggaaaatgtttttaatagaaggtaaggataaggtattaagaggttgaattgtgaatgaaaatatattacattaatttttattgttgggactttttgttattttatttagttagtctgtaatttgaagtattattagggttttagtatttttatctaatattattaatttttttattttatagtttaaagatcttagtgtaaaaaataatattgaaagattgataaaaatttgcagagaggtatttctgattttgaatttttatttttataatattaattattcttttaaataaagtatttatttctctgctttaattcgtagaatggttttaattttattaattactgtttatttatgattagtattagaattataaatttttattatttattatatctggttttaatttttctgtttttggttatgatttttttgttgtggcagattaatagattttatttatatcttggtcatttaatgcataacatgttgactgttaattgttttgatattgtatattaatttttaatttttgaaattaaaaattaaatacttgtttattactgatgaataaatttgattttaaattttttataaaaaatgttttagatgaggataaaattttatgtctacagataagagtaagactagggaattaatattaaatggcaatttatacaaggttctttttttaataagttttcctattgttataaccaatattattcaagctttttatgatcttactgatatgttttatgttggtaaacttggagccatgcctttgtcagcgctttcacttgctggtcctgtaaatttttttattatagctattgctatgggaatggctacgggaagcatttctttgatgtcaaaatgcataggagagggaaatttttctcgtttttcaagatatgcagggcaacttattgttttaaactttgttttatccttatttgttactatttgtgcttttttttttattgatcatcttttagatttgttgggtgtaaaaggggagcttaaagaactctcaagagtttatttttatgtgacaatttttgcaatacctatcatgtttttaagtatttcaattacatatattttaaatgctcaaggagaaactatcctttcaatgacaatagttttatttgccaatattgttaattttattcttgatccaattttaatatttagttttaatatgggcattactggagctgcttgggccactttattttcaaaattgttaaccgttgtcttttatttatttttgacttacaggctaaattatggattaaaaattcatctgaaggatttagtgatagatataagatccattaaagaaattgttaatctgggattgccttcaacttttgggcaaataatggtttcgttgtctttttttattttcaattatatagttattgagattagtccaaaatttttggcggcttatggacttacaaacaccattatttcttttttatttcttcctgctatgggaattggtactggaattatttcaattgttggtcaaaatcttggcgctaagaaagtcaatagggtggaagaagttttgaaaaaaggtttttttatttctttggcaattttattgataataaattcgattgttatttttaataaacagtttatactaaggttatttacaaatgatttagaagttttaaattatgctaataattatttattgttaacaactattggtacttttggatatggactccaacaagtattttttgggggacttattgggtctggcaggacaaaaattgcaatgattgttatttttattaggctgtggcttattcgtcttccagtagtttttatttttcaatattttggcataatggaaaattctttaggttatgcttttataatttcaaattatttggcaattataattttaattgcttttacttgcactcgttattgggttaagcctattttaattaaaaaatacaaatagtaattaagatttattttatatttacattttgccaaaaaatggcttatttgtttttaataaatttaatgtttttggccttaaaaatagattttagattctttgttaatctatttctaagtgtaattgtttgtttgcaataaagcttatttaagtagaattaattttaataattttaggttttaaatcatttctatttgttattgtttttcaaaaatgtataatgtggtttttcttttagtattgattttagtttttaaatgaaaagtttttgtttcaagcccattaagtttttctcttattaattcacctgttttgctaccttctttaaaaattgccaatgaatttgcatttatatcttctgtgcttttgtttttaagagtaattattagattatttttgctgtcggatttgtagtttactatttctactttttggttgatttttatagtgctaataagataggtaatttcttttgcattttcttttgattttattgtgcttgttttcatgcaagacataaaaacaattaaaatgccagaaattacaagtattggtaataatttaagcttaaatttttgagctttcatcatttttattatatttttttaccggggaaagtgttaacctttttgataaaataaaggtttttgatcaattttaaatagtgactagatttcaaaaagtatttactattgttttaaatttcatgtttttaaatgtattagttgagcattgcttattttaagtggttgcttttaaagctttattttttaatattttgtgcttttctttaattaatgtaaagtttatattaatttttaatgctattatatgtgtagtgaattgagtttaaaagtttaagcgtattgactatattttgtaaaatgtgtagaattttaaagctattaaaattttttagaaaaacacgtagtgcgggtcaatttctaaaaaattgatttttttatttttttgattatttgtagctattttcttattttaataagaataaatttgttaaaaattttttaaagagattaaatgtaagtagctatttagaatatgaaatttaggaggttagtcatggcaaaagaagtttttcaaagaacaaagccgcacatgaatgttggaacaataggtcatgttgatcatggtaaaacaacactaacagcggctattagtatttattgttcaaaattaaataaagatgcaaaagcattaaagtatgaagatattgataatgcacctgaagagaaagcaagaggaataacaattaatgctaggcatattgagtacgaaacagctaatagacattatgctcatgtagattgtccaggccatgccgattatataaaaaatatgattacaggagcagctcaaatggatgcagcgatacttttagttgctgctgatagtggtgctgagcctcaaacaaaagagcatttgcttcttgctcaaagaatgggaataaagaaaataatagtttttttaaataaattggacttagcagatcctgaacttgttgagcttgttgaagttgaagttttagaacttgttgaaaaatatggcttttcagctgatactccaataatcaaaggttcagcttttggggctatgtcaaatccagaagatcctgaatctacaaaatgcgttaaagaacttcttgaatctatggataattattttgatcttccagaaagagatattgacaagccatttttgcttgctgttgaagatgtattttctatttcaggaagaggcactgttgctactgggcgtattgaaagaggtattattaaagttggtcaagaagttgaaatagttggaattaaagaaaccagaaaaactactgttactggtgttgaaatgttccagaaaattcttgagcaaggtcaagcaggggataatgttggtcttcttttgagaggcgttgataaaaaagacattgagagggggcaagttttgtcagctccaggtacaattactccacacaagaaatttaaagcttcaatttattgtttgactaaagaagaaggcggtaggcacaagccatttttcccagggtatagaccacagttcttttttagaacaaccgatgttactggagttgttgctttagagggcaaagaaatggttatgcctggtgataatgttgatattattgttgagctgatctcttcaatagctatggataagaatgtagaatttgctgttcgagaaggtggaagaaccgttgcttcaggaagaattcttgagatattggaataggttaagactttaaggatatattaatactctctaaagtttaggagaataaattgattgctaaagataagatacgcgtaagattgtttagttttgatgttaaaatattagaccagagtgccgaatctattgttaaagctgttcagaaggctaaggctcagattaagggtccaatccctttgccgacaaaaataaaaaaatatactgttttacgttctcctcatgtcaataaaaaatcaagagagcaatttgagatgagaactcataaaaggcttattgatatcttagaacctacttctgctttaatggactctttaatgaaattagagcttccagcaggtgttgaggtagatattaaacagtaaatgatattttaagtatatgaatttgaggtattttaatgttgggattgattggaaaaaaagttggcatgactcagatatttcagaaaaatggcattgtggttcctgttactgttatagagtttcagcccaattatattatagggaagaagacagtcgatagagatggttatagtgctcttatagcaggttctgttgatcttaagagttctaaagtttcaaagcccataaaaggtcaatataaaagtttaaaagatattgaacctaaaagatatgtgatagagcttaaggggcttgacgggtatgatgctggcgatgagattaaggttgatgtttttaagtcagttaagtatgtagatgttacagggactactaaaggcaagggttttcaaggggctatgaaaaggcataattttagtggtggtccatcttctcatggatcaaaattccatagacatcttggtggaacaggacaagctactactcctgcaagaacatttaaagggaccaaaatggctggtagaatgggcggaaatcaacaaactattcaaaatcttgaagttgttttaatcgatgaagaaaaaagagcccttctagtaaaaggggctgtgcctggtgctaagggttcttttgttgttgttaagaaatctaaaaagtaggtatttagtatggaaagaaaagttttttctaaagatgggaaagagattggaactataaatttggatgatagagtttttaatatagaaattagtcatgggtctatttataatgctataaaaaacgagttgtctaatcttagggttggaacatcttcaactaaaaccagatcagaggttaggggtagttctaaaaagccttggaagcaaaaaggaaccggtagagctagggttggtacaaagcgaaatccagtttggattggcggaggtatagcattagggccaaagcctagggattatagctatagattgcctaaaaaggtaaaaaagcttgcatttaagtctgtattaagtttgcgtgctgctgatgaaaatagttttaaagttattgagaattttaatgttgaatctggaaaaacgaaagatcttgctttaataataaaaaattttgcaagttttaatggtaaggtggttattcttttgggcaatgatgatcagatgataaaaagggctggtaaaaatataagagatttaaagattttatcttttgataaacttagggttgttgatttattttatgctaagaatttaatagctctagaatccgctgttaacaagctcaatgagttttacattaaataaaaaggatgttgaggataagtatgaaggcttatgatataatagtttcacctatgcttactgaaaaaactaatactcaaagggaaagtattaatgtttatgtttttaaagttaataagagagcaaataaaaaagaggttggtgcagcaataaaagaacttttcaatgttactccagtatcgtgtaatttgctcaatattaaaagtaaagccaaggttgtggtgtctagaaaagggtaccctataggtaagggaaaaacttcttcatggaagaaggcatatgtttatctcaaaaaggaagataaaatagatattttttagtggttttggagaaaaataaatatgggtattaagacttataagccaaaaacttcttctttgcgctataagacgactttatcttttgatgatttgagcaaaggtaatgatcctttgaaatctttaacaaaaggtaaaaaatttaaatcgggcagagattcttctggtaggattagtattagaagaagaggtggtgggcataagagaaagtataggttgattgattttaatcgaagagataaatttagcattcctgctcgagttgcttctattgaatatgatcctaatagaagtgctaatatagctttgcttgtttataaagatggagaaaaaaggtatattatttctcctaaaggcattaaggttggagatgttttggaaagtggtcctaatgctccaattaaaattggcaatgccttacctcttgaaaatattcctattggaagaaccgttcacaatattgagcttaatgttggaaagggtggacagcttataagaagtgctggtggatatgctatgatacttgcttctgacgggaattatgtcactgtaaaattatcatctggcgagatgagattgatttttaaaaaatgtattgcaacaattggtgaaattggaaatgaagattatgccaatatttctatagggaaagctggtaaaagtaggtggcttggtagaagacccaaggttagaggtgttgctatgaatcctgttgaccatccacatggtgggggtgaaggaaaaacttctggaggtcgtcatcctgtgtctccttggggacagcctactaaaggttataagactcgcaagaaaaagagatattcagataaatttattattaaaagaagaaataaataggagagtatagtggcaagatctattaaaaaaggaccttttatagaaaagagtctttatcaaaaagttttatcgtcttttggaagtgagaagagggttgttattaaaacctactccagatcttcaacaataattcctgaaatggtaagccttactatatctgtttacaatggcaaaacttttatacctatttatattaccgaggatcttgtgggacataagcttggcgagttttcacctacaaggatttttagagggcatgctaagtcagataaaaagggaaggaagtaagtagttatgttggtaaatagaagatatacggcaaagggcaaaaatttaccctcttctccaaaaaaagttaggccaatagctgacaatatccggggagagtcttatattaaggctattgcagtgctttgttctatgcctaataaaggagctaagcttttagaaaaagttgttaagtcagcagcatcaaatgctatgtatcacaataaaaatctttccgaggacatgatatttgttaaaacagttatggttgatgatgggcgtcgtcgtaaaaagatttggcctagagctaggggtagagctgataggcttgttaatagaaattgtcatatttttgttgaagttgatgaaaaaaaagatattaaaggataaagcatgggccaaaaagtacatccatatagcttaagggtaaaaattaataaggattggaagtcaaaatggtattttgataaaaaattgtattctgcaattcttcatgaagattttttaataaggcgagaaattatgaaatttcttaaagggattaaatttgatatttctgatatagaaataattagaaataatccccaaaaagtaacagtagtaattgttactccaaggcctggttctgtgatagggcttaaaggttctaatcttgaaaagattggtcaattgttaactaaaaaaatttctaaaaagattagcattaagattaaagaggttaaaagacctgagcttgatgctcaaattattgctaatgggattgcaaagcaagtagaaaatagggcgtcttatagaaaagttttaaaatcatctctttctacctctatgttaaaaggtgctcaagggttaaaaattaaaattgctggtagacttggtggggcggaaattgctcgaagctttgaggttaaggaaggtcgggttcctttgcacactcttagagccaatatagattatggattttctgaggctcaaactacttatggcattattggagttaaggtttggttatttaaaggtgaagttttggggagacaaactaattctgatgctggccaggtaataaataaaaagccttttagggaaagaggcgatgctgttaaaaattttgataaaactttaaataatagagaaaaggctaatgaaaagcaaactaggcttttggataaaaaagatgggctgtctaaagatgaagtagatcttttaaacaaaaaaaaatttagtgcgtctttttctaaagaaagagacgattctaatgagcaggatattggaggataattagatgttaagtccaaaaaaggttaaatatagaaagaagcagagaggaagattgtctggagaggcccagaagggcaataaaatttcttttggtgaatatggacttgtttctttggaaacaaattttattactgctcgtcaaattgaggctgctcgtattgcaatgactcgtaaaataaaaagaggcggaagggtttggataagaatatttcctgatattccttatactaaaaaaccagctgaaactagaatgggtaagggcaaagggggtgttgatcattggaatgctcctgttaagcttggcactgttatgtttgaaatgtcaggggttgttgaggaacttgctcaagaggctatgtcgcttgcaagctctaagcttccagtaaaaaccatgtttgttgtaaggcgagatttgaggtaattatgttgaaaaatttcaaaaattttactcttgaggacatgaaggctaaaaggctagaattaaagaaagaatatttagatttaagatttaaatctgttgttggtcatgttgaaaatcctttaaagaaaagagagattagacgtgatattgcaaggcttaatacaatgatttgtgaatatgaattaggtattagaaaggtttagatatggcaagagaaaataaaaaagaattaattggtaaagttgttagtgataaaatgtctaagactatagtagtagaaattgttcaaagaaagatgcatccaatttatcataagtatttaaaggttagtaaaaaagttaaagcacatgatgaaaaagaagtttcaaaggttggcgataaggtaaaaattattgaagttcgacctattagtaaagataaaagatggtctcttgttgaggttttagaaaaattaaaatagttttgatttttctaaaggaggttgattgtgattcagatgcaaacttatttaacaattgcggataatactggtggcaaggtggctcaatgtattaaggtgcttggtggcagtaaaaggcgttatgccaaaattggggatataataaccattgtagtaaaacaagcaattcctaattcttctgttaaaaaaggagatgtttataaagccgtaattgttaggacttctaaagaagtaagacgtaaaaacggaacttatgttaggtttgatgataatgcttgtgtgatacttgatgctaatttaagtcctaggggcaaaagggtatttgggcctgttgcaagagaacttagggatgctaattttatgaaagtagtatcattggcttcagaggttatatagcaaaagggggttttgtgaagacaaagttgaagataggtgatagcgtaaaaattctttctggaaaagataggggtagaataggtaagattgctagtataaatagaaaaaaaaataaagttattgttgaatcttgcaatatggttaaaaaagtcattaaagctaggacaccccaagaaaaaggcagaataatagataaggaggccgctatagatatttcaaatgtgatgatatttgtcaagggaacttcttcaagattgggcattagatttgaaaataatgaaaaaataaggtatcttaaaaaaaatggacagaggatatagagtttatgaattatgttcctgaattgaagaaatattataaagacagtgttataaaagagcttgttaaggaatttgaatataaatctataatgcaagttcccaagcttgagaagatagtgatttctgtaggtgttggggaggctgttaggaataagaagttattagattctgctgttttagagcttgctcagatcactggtcagaaagctgtaaagacaaaagcaaaaaaagcaatagccgggtttaaaattagacaaggacaagaaataggtgctaaagttacacttaggggcaatgcaatgtatgaatttttatataagcttattcatttagcattgccaagagttaaggattttaggggaatcaatggggatgcttttgatggcaatggaaattactcttttgggataacggaacaaataatattttctgaaatagactatgataaaatagagagaatatctggtttgaatattacaattgtgacaacagcttcaaatgataaagaaagtaaagctttgcttttgaaatttggaatgccgtttagtaattaggggatttataaggtatatggcaaaaaaatcaatgattattagggctttaagaaagcctaagtataaaacaaggcaaaataatagatgtaaattatgtggtcgtccaagaggatatttaagagatttttgtatgtgtcgaatatgttttagaaagtatgcgtctgaaggattaattcctggcgtttcaaaatcaagttggtaagggaattttatggcgattacttattcaataggagacatgctaactaaattaagaaatgcaagcagagttgggcatggatctgtagatttaaagatgtctaatatgaataaatcaatattaaacattcttaaagaagagggttatattaaggattttaattttttagaaaagaaaggaattgcttttattagggttttgctaaagtatgacaacaaaagaaatcctgttataaataaaatagatgccatttctactcctggtagaaaaatttattcttcatatagaaatatgccaagaataaagaatggatatggaatattaattatatcttcttctcaaggtgttattactggtaaggaagctaaagataaaaaaataggtggtgagttgatttgctcagtttggtagtttaatagggggatgtatgtcacgtattggaagacttccgataaagattccagatgctgttaaggttgatgttaaagacaacttagtgatagttgaaggtattaggggaagattagttcaagatataaaagacagtattaatgttaaagttgagaatggcagcgttattgttgatcgagttttaaatgataaaaaagcaaaagcctaccatggtctttacagaagtttaatttttaacatggtaaaaggagtgactgaaggattttctaagtctcttactataaatggtataggatatagggtagagcaacaaggcaatagcctttttttaagccttggttattcaactcagtttgaatatgttattccagatggtattagcgtaaagcttgatgggaatactaaaatttcagttgaaggaatagacaagtttaaggttggtcaggttgctgctgagattagaagtttaaaaaaaccagagccgtataaaggaaagggtattaagtatgataatgaagttattagaagaaaagttggaaaatctggtgtaaaaaaataaattttaggttaataattatgaaaaaaataaaagaagcagaacagagaaagcttagacgtaaaaaaagaataaaggacaaaatagggcgcggagtagctagtaggccacgaattactgtatttaaatctaataggtatttttatgcgcaagttatagatgatagtaagggacatactattgcaagtatttctactattgaaaaaagtcttaatttaggcaaaaatattgatgatgtaaaaaaacttggagaagttcttgctaaaaggcttaaggagaaaaatataaataatcttatttttgacagaaatggttataagtatcatggacttattgcaagttttgcaacttctttgagagagtttggtattaatatttaagggagtgtatttatggtagatgttcatgctcaaagaaagcagatagaaaaattaatatcactcaacagagttactaaggttgttaagggcggaagaagattctcttttgctgctttcatggttgttggagatggagaaggacatgttggttggggctttggtaaagctaatgatgctagtgatgcaataaaaaaaagtttaacaagtgctaggaagaatttaagatttgttcctattcgaaaaggaacattgccacatgaggttattggctgctttaaaaaagctaaggttttaatcaaaccagctactcatggtactggtgttattgcagggggccctgttcgtgctgtaatggaggctttaggagtgcatgatattttgagcaaatctcttggttctaataattctatgaatgtagtaaaggcgacttttaaggcatttgatttagttttgaatgctgaaaaagtagcagaaatgcgaggaaaaactttgaaaactttatggggttaatgtatgattaaaaggaaattaagattacaactaaagaaagctaggtttaatgcttcaaggtctagatctaagaataaatgttttattaaaagaatggaaaataatagaaaaattatttctaaaaacaatattaatgtgcaagtttttcttgtaagaagtcttattgggaaattaaataaaaaggtcaaagttttaaaagcattaggtttaaataaaataggcgataaaaaggttcattttttaaatgaatctattaagggtatgcttaacgagactattaatatgattttattaagcgaggtaatgtaatgtttaacttgttaaagcctaagggagcgagcaagcgacgtaaaattgttggcagaggtccaggttcaggacttggcaaaacttctgggagaggtcaaaaagggcaaaaagcaagaaatacttcgccaagacttggatttgaaggtgggcagactcctctttatagaagattgccaaggaaaggtttttctaatagtgattataaattggaatatgcaattgttaatcttggagatatagataaaaaatttaaggatggacaagttgtcaattatgatactttgcttgaaaataaacttataaaaaagaaaaataaaaaaattaagattttgtctaatggtaagcttacaaaaaaagtttcttttgaggtttctaaaatttctaaatctgccgaaagccttgtaataaaaattggttgtactattcaattagtttaaagtggaataaagatgaaagaattgtttttaagtttatttaccgttaaggatttgagaaataagttcttgtttactttatttgttctttttctttttagagttggttcatatttgccgataccaggaatagattctgtagctcttaaaagttatttcaagtcgcaatcagatttttcaattgctaattattttgattttttttcagggggagcttttagtaatttttctatatttatgcttagtatagggccttacatttcggcatctattattgttcagcttcttgtttattcttttccttctttgaaaaaaatgcaagaaggtgacggcggaagacaaaagactaaaaaatatacaaaatatttaacaatagttgcagctgtagttcaaggatacgcaacaagcctttatgctaaaggtattccgggtgctgttaccattcccttttatagatatatatttgttgctattttaacggttactacggggacatttatccttttgtggtttggagagcaaattaatcaaagaggtgtaggtaatggaacatctttgataattttttctggcatagtggttagacttcaagcagctttgtttaacttattccaaagcatgcaggatccttctcaaaatgttaatcctgtttttgttatacttattataagtatatttattttagttgttatattgattatatatgaatataaggctcaaatgcgaattgccattcattatgctagagcaaattctaataatacagttagttcatatttgccaatcaagttgaatccatcgggcgttttgcctgttatttttgcctctgttttaattactctgcctttacaaattttaagtggcttcgcagaaacttcttccatagccaggcaaattttatcttatttaaggcctaatggtttttattatacttttttgaatgtaattttgataattggatttacgtatttttattctaagattcagttaagccctaaagacataagtaataatattcgtaagaatgggggcactattccaggaataaagtctgatgagatggaaaaatatttagatgaaattatgaataaaactttattttcaggatctatttttttgtcaattattgcaattattccatttttagtgcaaaatatttttagatttccacacgatgtttctagaataatgggggggtcttctttgcttattatggtaggggttgctcttgatacattaattcatattgatgcttatttgaaaactcaaggattttctcatggaaataaaaagaattatgcatttttgcaaaaaatttaggagtgtttgattatgaaagttagagtaagtgtaaagccaatttgtgaaaaatgtaaggttataaaaagaaaaggtgtattaagaattatttgtgataatttaaagcataaacaaagacaaaagtaaaaattagaggaaataaaatggctagaatatcgggaatagatttaccaaataataaacaattaaaaatagctcttacttctatttatggtataggtagaacaagagctttggaagtttgcaataaatcaagtatttctccaagcaaaattgctaaagatttagataatgatgaagttaatcgacttaggaaggtaattgagagcgattatattgtagaaggaaaacttagaagtgaagttgcaatgtctattaaaagacttatggatatagcgtgttataggggcgttaggcatagaaaaggattgcctttgagaggacagagaactaaaacgaatgcaagaactagaaaaggaaaaagaaagactgtagctaacaagaaaatagctagcaaataaatagtttttaagatttggagggcaagttgagcgcaaaattatcaactaatagtaaaaaaaaaattaaaagaaatatcggagaaggaaacgtttatatacaagctacttttaataataccatagttactgtatctgatataaagggaaatgctttagcttgggcaagtgctggtggtatgggttttaaaggtgctaaaaagtcgaccccatatgctgctcaaataacagcagagtctgctttaaataaagtgagagattttggaattaattatgttcatgtgtatataaaagggccaggcattggcagagaatctgcaataagagctattggttcgattggtatgactgtaaaatcaatttcagatattactcccattcctcataatggatgcagaccgaaaaaaaccagacgagtttagctagaaggagttatgatgcttgtggaaaaatttttgaaagatttcactatacctgaaaaaattgaatttttgaaaagccaaggtgatgggtcttatggtaaatttacgatatatccttttgaaagaggctttggaattactataggtaatactttaagacgtgtgttactttcttctattgaagggtatgcgattactgctatgagagttcagtctaacaataaagactcttcgtcaaaggttgtttcaagtgaatttgatttgattcctggagtttctgaagatactcttgagattattgctaatattaaaaatattcatttgaaacttggagaaggagagcaaagaaagacaataagctttagtgttagcggtaaagacaccaatgttttaaaagcttctcattttgaaagagatggagttgaggtttttaataaagatttagttatagctactttatcacatgatgttaatttagatcttgaatttcaaattaattatggtaggggctatgtgtcttctgagcaaaattctaagtatttagaagaggttaatgttattgctttagattctatattttctcctatagagaaagtttcgtattctgtagaagatactagggttggtcaaaggtcagattatgacaagcttgtaatggaaatttggactacaggtgtgatttctgccaaagatgcaataaaaaaggctgcatcaatagtaagagagtttttgtttcctcttgttgattttgaagacaatgttaatacatcttttgagaaatcaaaatcagaaagttctaacttgcttgatatgagtattgagaaattgaatttgtcagtcagatctttaaattgtttggccaaagaaaatgttaggactttaggagaacttattagtaaaaacgcagaagagctttctaaagctagaaattttgggaaaaaaagtttggaagagataatcgaaaaacttggttcttatcgattatatttaggaatgtctaaagaagatgctctatctgtattgagtaagaatgttaaaatatctgaataaaaggagagtttaggctatttcatgaaaacaaaattgggttttaatagattaagtaggaagtctagtcacaggagagcgcttttaaaaaatatggtaatttctttttttaagcatgaaaaaatttcttccactaagacaaaattgttcgaagttaaaagatttgctgaaagattgattacaagggcaaaagttgatactgtgcataataggcgagaattatcaaaatttatacatgataagcatattttaaataagctatttaccaaaatttctcctgtttttagacaaagaagtggtgggtatactcggatgattaaattaggaaaaagatatggagatgcggctgaaatggctatcctagaattagttgaaaagcctttaaaagttgaataattaataatttgagggcactgttttaaagattaaattttaaattgcttttaaacagcataggagttaaatgatatgatatatattattttttcttctatttttgctggctttatattaggatttttagtaagagtttttttaggtagattgtctttattagatttagaaaaaaatctgaaaaaagtaagagtagaatcacaattagagatagaaaatgaaagaaggcaaattattgctaatgcaaaatctcaaatgcttaaagaaaaaaaccagcaagatagggatataagagatcggaaaaatgagattgttaatttagaaaaaagattattacaaagagaagaaactttagataagagaatatctgctcttgacaaacagcagtctagagttgattttaaaattaaagaatttgaacaaaaagaaaaagtaataagagaaaaagaggccgatcttgttaaaagattggaaaatatttctggtcttacaagagaagatgcaagaaaaattgtaattgaaaaagttgagcatgagtccaaaagagatgctcaagttattatcaataaaagtgagcaggaagcacagctattagcagataaggttgcaaaagatattttagtatctactatgcagcgtattgttacggaggtgagttctgagtttacagtggcttctgttgagctacctaatgatgagatgaaaggtaggattataggtaaagaagggcgcaatattagggctcttgagactttaataggagcagatatcattattgatgatacgcctgaagctgttgttatatcttgctttgatccaataagaaaagagcttgccaagaggactttagaaaggcttgttacagatggcagaattcatcctgctaggattgaagaagttgtgtataatgttaccaatgagataaatagcattattcaagaagagggtgagaaggtggtttttgaccttaatatacatgggcttgataagagacttattagggggttgggaaggctttactttagaagcagttatggtcaaaatgttttaagccactctaaagaaacggctataataggagaaattttggctaaagagatgaaattagatcctgttgtagtaaaaagagcatgccttttgcatgatattgggaaagggatggaaagtatttctgataatagcgagggacatgctattactggtgctgaacttgctcaaagttgcggagagagcgaaattgttgttaatgctattgctgcgcatcacaatgaggtgaaacccgagagtcttgaggctattgtggttcaaatagcagatgccatttcagcatctcgtcctggagcaagaagggaaagtttaaataactatataaatagacttaaaagacttgaagacattgcgtatagttttgagggtgttcaaaaatgttatgctattcaggcaggtcgtgaagttagaattattgttgacaatgctttaattaatgatgaaaagtcaattttacttgcaagagatattgctaagaagatagaagctgaaatgagatatcctggaaaaattaaagttacaattattcgcgaaaccagagttattgaatatgcaagatagcactattaaaaccttgataattggggatataataggcgagagtggattaaaaaaagttttttttaatcttaaaaacattaagaataaatatagaatagatttagtaattgctaatggagaaaattcttcaaatggttttggaataactccagaaatagcaaataatctttttagatcgggggttaatgttattactaccggtaatcatgtgtattctaattgcaaaataaatgattacctaaataagcaaacatatatcttaaggccaaataatttttcagatttgttagatgggcatggttattgttttttaactattagagatgaaaaagttgctgttgttaatgttcaaggggttttaaatatgaattttattgttaaaaatccttttgataatacaaaaaaattggttaatatgctgagtaataaagccaaaaccatttttgtagattttcatgctgaaagtaattatgaaaaagaaagttttggatattttttaaatggttttgtaacaggtgtggttggtactcatacccatgttatgactcaagatgaaagaatattgtcaaaggggacagcctatattagtgatattgggatgacaggtggattaaattctgtaataggatttaatcccgacatttctcttaagggcttacttgaatatacccccttgagagctgaagttgtagaagatgacacaattttacaaggagttattattacttctaatttaaagacaggccgcgctttaaaaattgaaaggattcagaaataatttattaaatatactttgtaaaaggtatccagaaaaaacacgaaaagaattaatgatcttaattctaaaaggcaatatatatgtaaattctcataaagaraaaaatcctaaaatattaataaacaaaacaagtaaaatagatttagttgagaatacttgtcaaacatttgtatcaagaggaggttacaagcttttagaggctcttaaagattttgaaatcgaagttaaaaataaaatttgtgttgatgttggctcttcaactggtggttttaccgattgtctattgcagtgtggcgccaattttgtttattcaattgatgtaggcattaatcaactctcttataaattaagaattgatccaagagttaaagttttagagagaactaatatttttgatgttacagaatttaagattgttcccaattttgccgttgtagatgtttcttttagatcatcaataagtatatgtgtaaatttaatagataaactttctgataattttattatagttttgattaaacctcagtttgagtttaaaagtttaaatttagatataaaaaattttaatggtgttgtgagtggtgagtatttgaagataattttgcaaagcgtaattgaaaagttctataaaaataaattacaagttaaaaagatattaaagttaaaaactaaaggtaaaaaaggcaatcaagaattcatgtttttagttgttaagtcaagtgttttaagaattgcaagctctatgcaattgcttagcaatattgaattttaatatttgtccagagcctttttgtttaatattcctgagaaatttaagtttaattcttcaagtattattggattattttctattgttaaaattattccatcaattcctttaatttcaagacatgttaaggttatttgagcgatttgattaattattccttcaattccaaaactattttcataaaattctttagataagtttattttggcaattccttcgcttaggcttaaatttaaaagcttggtttttatagggattaaacttaaaaaattattttttagctcgtattcatttggtcctttgattaaagattttagtgtttcttcaagaatatttttgtcgtaatatatagctctttttacagtttgtcttaaaaaataaccttctggggttacttttataaaataaagtttaataaattttttgtttttaaggttattatttctttggttttgcttgagctcttcttcaagtttttttatttctggtggctggattaaaaaactttcatttttaagtatttttacatttgtatttttattggtgttttttttagcttcaattaatttattatcttgtgtttgacttgattcgaataaactgttatcataatttttttctttaaaaatatgtataataagtgaatttttaattattaatagcacactaattattgttaaaacaatagcaattaaaattaaaagtatgtctgatttggttgagcttgaacttttttttcttttcaatataaacactcatgtgtaattggcataaatactaatatttgctattataatggaaatatcggaataaataaagaggtgtatttgctttgcttagttataaaaaggttcttattgttggtagaccaaatgttggtaaatctgctttatttaatcgaattttagatacaaaaagaagtattactgagagtacttacggtgttactagagatttagttgaagaagtttgtaaggttgattcttttaagtttaaattaatcgatactggtgggtttactatcttgaaagatgagattagcaaaattgttgtgcaaaaggttttaagctctttagaaaaagttgatttaattttattggttttagatattaatgaaattttacttgaagattatcagattattgaaagactgagaaaatatagtagtaaggtggttttggttttaaacaaagtagatactaaggataaggaatgtttagctcacgaatttcataatttaggattcaagcgctattttctggttagtgcagcccattgtcgaggcattactaagcttagagattttttaaaagtagaagttggtgaagttggcattgagagtggcgctgatattaaggttgggattataggcaagcctaattcaggcaaatctacccttattaattatttatctggaaatgaaattgcaattgtttctgatcaacctggtactactagagattttattaaaactaagtttactagaaatgggaaagtttttgaggttgttgatacagctgggataaggcgaagggcaagagtaaatgaaattgttgaatattattctgttaatagggccctaaaagtaattgacatggtagatattgtgtttttattgattgatgttcaagaaaaattgacttctcaggataaaaaaattgctcattatgttactaaaaaggggaaaggaattgttattgtgtttagcaaatgggatcttgtggatgagtctaaaggttattttgaagccttaaagagccatgtgaagtttttttttcctattttaaattttgctcctatatttagaatttctgttcataaaaggataggtttagattctctttttaaagaatcttttaagttaaaagatcagcttgagcttaaaaccagtactccagatctaaataaaatgttaaatttatggatcaaagattatcatttaaatatttctcataaaatcaaatatattacacaagttagtactaatcctgttaagtttattctttttgcaaataaaataaagaattttccaaattcttactataattatttagtaaataatttgcgtaaaattggatataaaaatattccaattttagtagaattaaaggaaaaaataagagatttaaagtgagatatatatttttattcttaatatttaagagtctaaatctttttgcgcttgagagttttttttatgattttgatgtaaggactaaatatttaaaatattttaattcaagctatgcgcaaaaaaaaataagcccaataaaacattttattacagaagattgttacattgaagtttcaagtgaaatttcttctgagtatgtttattattctttttttaataaaaaaaagaatgtaggttatatttttccagggtcttacgtgattaaagtgggcaaagagggtattgagcagataaaaatattttttataaacagaggggatacgtttattagaataaagtcttcaaaattttcttctattgctgatttttatttagtaaatactttgatttataaagacgttaaattgccctttaagattgaagacattgcggtaatttctcttgccaatataataaattatattggcaaggttgttgattttagatattttattcctgaatattttgatatttataaaaatatttctaatatggtaattagtttaagaaaatctcttagatcttttcccattgctgaggttgctgatggtgcaatgaatgaatatggtaaaatggtgcatatagaaactgggctgttgcaaaaagatcctgtagggtttaattgctcaggatttgttaaatgggtagcggattcgatttataaatcaatgacgggaagacttttaaaaattgatgatcttaagcttagacatattggcgttagaggcagtggttttactagaagtcaggaatttaataaggatcctttttttggtcttgattggattcgtaatattgcttataggataaataatattaatgtagatttaaatttatctaaaatcaaggaaaatgatgtcaataatattaagttttttgattatattgacaatcgtggttataaaattgaaaatttagagtttttattatatagtctggctttagatgagcctggatatatttatttaggatctattagcacgggtgttaacaatttatcaagcatggtgcttcataaacatgttgttttgtttcttccatttcttgatgaaaataggatttttagggtttctgttaacgaagttaatgctgaaacttcaatcaagtctctccagaaaagatatccaaaatcttatattcatttagttagagttaaagttcctgaaaatttaccaatagtgcctatacctataaaggcaaataatcaatcatcatgattaaagctgtagtatttgatttagatggcaccttgtatcctgaggcggatagaaataagctaatgttttttgaatttttaactaatgttaagttttttttagcttttaaacagattaggaaaaaaatacgaattttacaaagcaatcaattttcaccctcaaatagggatgaactcttttaccttgcaggttcaaaatgctttctgagtatttaaatccttgatgagaatcggtgtgcttttttgttaaataaaatatattatagtcaaatttttagcgataagtttaaaaaactcaagccatatcttggagttgcaagatttaatctattggcttaaattcaagggaataaaattaggtgtaatgtcagactttcctattttaggtcgtgtcaaaaatttattgggcattcaagacagtttttgggatattctttattcttcagaagatactggatatttaaagccccataaagcaccttttttaaaagttattgaggatttaaatttaaggagtaataatattttgtatgtagggaattcttatgaatatgacattttaggtgctagaaatgtttcaatgaaagcagcttttttttcaacaaaaaagaatataaattacaagggaatgattgactttatttttcatgattataaagacttaagagaatatatacgtttgaatatatagaatatgggtaaaatattttatgatagattttgcgactattttagttaacctttttttggtttcaatagttttatttgtttataggcaatacgataaacgttctagagcattagataaaattaaaaagttcgttgatcttacaaaggttaatcttgaagattttattgaagataagacaaaagagattaatgatcttgctgttgatatggaagcttatcaaagatctagtatagaaataataaaaaagattgaggaagttcagcaaaagattaaaaataaaagcaatgattttgcagaggttgaaaaaaagatagcctatcatgattctatgcttaaggatcttgatgaaatgacttttaaagttcaagagaatatacaaagattgcaagttgatgggaaaatagtagataaactttcaaaaactttaaaaggatttaatactcagattgattcggttgaatcaaatttgaattcagtgttagaaaaatttgacaaggctaataaagaaaatctcgagtctattaaaattgctagttgggaaaagtttgacactaatattaaggaacttgtttttaaaatagataatttaaataaagagattagtctttatgaaaaagatttagcaaatattgaagagagaaaaaatgatattttagttaagggtaatgagaaattagatttagaatttagcgattttcttgaaaaggtcgaatttaatattggcaaatacagcaaagagattgaaagttcttttaatttttatgaaaacaaatataagttaatagaaaattctatagagcttattatggagagtgtgaagaataaaattaatgaaaaagaagattttattttaaatagactgaatgaagaattgcaaaataaatttaaggatatcttagtatatgttgatgatcgctctaaggaaattaaagataagcttgaagataaattggttttggtggacaatgaaatttcttctatgagttcttcctttaaagacaatgtttattcaagaattaattcacttgaggagtcaatgcgaatagagatgggaaagtatgaagagcaagttgatgatgtttttgataaatttagatctcaagttgagttgaatcttaaaaatatttatgaggattatgaagataaaataagtcaagttgataataacattagagaaagggtagagcttagtttgttagatttgaattctaaaatggaaagtgttcagtctggtgctattgattttataaagaggcttgaagatgattctaatggaatatatcttgaatttaaaggtaagtttggggcagatattgaagtttttagtgaaagttttaaaggtgatattaatcaacttaagatgcagttagaatcccaactcttagatgttgattcaaatattcaagaaaagcttattaagcttaatgataatttgatttctaattttgaagaaattaatggtaggtttaataataattactcaaatttaaatgataatataaatgccaagtacacagctctttttgaatctttggattctagcagctctaaatttgaaaatcaaatggaatctaaatataagagctttacagataaattaacagcaggaatggatgaattttctttaatgtatggtgagaaatttgagacactctctcaagaggcgactaataattatcaagaatttcaagatttaaacaaaaaattagaaaatgaaattgaatctttttataatatgtttgaaaaaacccaagagactttaaaggtagattttaatactagtttaattaatattaaagatgaaattggtaaaaatatagtagagtttagggatcgttattacgatgaggtaaatatttttgttactcagctagaagaaagcaagcttcaatattcaaagtggcaaggtgaaatggattctaatttaaagaatattgaatctcaaataaataaaacaaatgaagaatttttaagtttaattcagattcaaaaagacaaaggaatagagcttagtgagagcgtttttaatgatctgtcagatcatattcaaaaaaaagctattgatatgcatggcagttggaaagatgagcttattgctttaaataaatctttgcttgatattaaggtttctagtgaagagctactttcatctgctactttaaaaatagaaagtttagaaaaagatgttaacgatagaatggaatatgttttattaaaaacaggcgatattgagagtttagtgatagaaaaatacaaagaattaaaagatatgtcatattcacaaagtgatgaggctatattaggaattaaagagtttattaatagacaaacagaaataattaaagataaaagcgtgtttatgcttgaggatttgaataaaaaatttgatgataagaataattttgttataagcaagattgaagaatgtgattataaattaaaagatttcaagattgaatcagaagatattttaaataattttaagtctgatcttaatgaatttattgagtcaaaactacaaattgtctctaatataaaatcggataatcaaaagcaaattgatgattttttagatagaatttctaaagatattttaaacaggaaagattcaattaacaatgaagtagatagcaagcttagtgattggcaaagtaaattaaatgaaataactgttaaaattgaaaatttattgtcttcaggtaaagttgatctggatttaatagattctgaggtgactacaaaaattaaagagcttaaattttctatagaaagccttgagagttattatcttgagaaaatagatgagtttagaaatcaaggtgccatatactctgatgagcttttgcaagacataatgaaccattttaataaagagactagagaacttgaagaaaatttatcaaaaaaatttgctgcggttttaaataattcagaggaatttgttaaagaggttgatagtttattgcaggacaaaagaaccgatattgcttcttttcaggctaacatagatattactcttgattctcttaatgtgaagtttaatgatataaacaaagaaattaatggaaaatacaatgaggtgatatctaattatagggggtattcagagaatatttctagtaaacttgaaaatgaaataatgcatgagattgaaaatctaagcagaagattgacagatagaatagatagtcttagtaaaggtatggatgaaaatcttcaaaaacttaaggaatcttttgatgtatcaaaatatcaagttgaaaaatttgaattgaaagttaaagatttaacagatgatggagaagcaaaaattaacaagcttgttaaagagatcgaacagtattataaatctagattagaagaagcaattgattatagaagaacgattgataacgatattatgcaagcaaaagagagatttggggagataacaaatgagcttaaaaataatattgagagtaagtctgagtttttaaacgatctttataaggaaagatttaaacttattgagagtaattttgaagagagatattctacatttttaattgaaagcgagggagctatttcaaaaattagagatgaaatctataaaacacttacaagtaatgatgaaaatttgcaaattaagatttctgaaatggatcaaaattttgagataatagagcaaagatcaaaagatattttagaatttgaaaaagaattgcaagataaaattaaagattgttacggttttataaattctcaatttggagagattaaggcaggtgttgaagagaatataaaaaatcattttgatgtttgtataaaaaaggtaaataccttgattgatgatgacattgtaaagtatgaaaatgaaattcacaagagaattgattctttaaaatcgattgagagtacttttgatagcatagagaaaaatttaaatgataaggtgagtgggtgtattgataaaatagctaatgattttaatcttaagtatattgaacttgaagaaaggtgtaatgaagggcaattaaatttagagaataaaattgacaacaaaattaaagccattgataatttagctttaagtcaatatgatggacttgagaaaaagtatgctgatatgtacgatgagttttcagagagattaaattcttatattgcaactttaagtgaagagtttaagagttcaaataaagagatgatttttgaacttgaatctcaactgaaaaatcttaaaaatcttgaatctgatttaaataatgttgaaaaggatgttattagattaaaagaagagtcttatcacaatgtttcatcacatcttaaattattagaagaagacttttttaaagatttaaaaattagaggcgaagagcttaaatattctttagaaaactttattgcctcatataatgataaaattcaaaatttagaatatgatttgtctaaaaatttggaaaacaaaacagaacttattcaaagtttccgtttagatattgaacaaaaaatgaaagatgataaagagaatttttatttagattttactaaagaattttcttctaaaaaaaaagatatgcagagcgagatagctttaatggaaaccaatattaccggaaaagtagatgaatttgttgattttgtaaataataagcaaagtattattgattcttggtttttgaatattaaagatgatgtaaaagattggcaagaaaaatcttatagcacaatagagaagagaataaatcttgctgagcttggaattaaatcatttgagaatgatatttttaatgttaagattggtttagaatcttttaaagatggttttgagattaaggctgaggagatttttagcaatttgcaaaacgaggctaaaaaaattgaacaatcagttcatcttgattttaaaaatattggcgaatcattaaatcttaaagttttagatcttgaaaaatttgttgattttaaattagaaaagatagatgaaaaggttaataaaaaaacagaagacatcttaattcaagcagaagtgaaatttttaactcagcaaaaggatcttgaagataagatctttgagcttaatcagaaattagagcatgaatttacaaccttgtcttctaatcttgataaagtaaggcgggaaatggttgatgtaatttctagtgataaagaaagctttgaagggcaaattgaattaattaataaaaatatttcagaattttctgagaaaattagtttatacagaaataatattgagacatcaattgagaatgaatataattcgttttctaaatctataaaatcagatctcggcttacttgaagatgagcttaaaaaaagtttaaaacattcaacatcagagattgaaaccataaagagtggtttgcaagaacaaattgataaatttgaggttgaatttaagaaaaatcataaagaattattaaaagaagttgataataatattttagaacttgaatctaaaatattaaattgtgatgttcaatttaacaaatttattagtgagattaaagacaatttagttgaatacaaatctgatttgagagcagaatttgaagatagttatgataaaataaattttcaaatcgaaaatcaaattgaaaattttaaaaaattagattctgaacttgaaaagaataattcaatatttttggaggcttattctcttaaggacaagttggaaaaattatgggaaactttaaaaaatgagatagggcttgctcaggaatataaaaataattttgaaaacgttaacaaagaattttataatattcaaaaagaaacattgggtattattgaaatttttaatgagctaaagttagaacaagaatcaattaaatctattaaaaatgattttaatagattttttgaattttactcttcatttgatagtagatataagagtttaattgaatcttatgatgaaatgcagatatataaagctaaaataaaagagatagctgacgagcagagaactattcttgataattatgaaagaattagcaataaagagagcatattaaagagtactatagagtctgttgataaaaattttgatttaataaatgaagtggagaaaagatttaataatttaagcaaagagagtgctaagattcaagacaatctcaaggatatggaaaatgttgtttcaagtctcttattaaacaaagggttgtcagaagaagtgttgattaatgctcaaaatttaaaggaaatgctattagatattgaaaataagttgaaaaatactttgactatgagagagagggtggtgaaatctgagacaaggttggagaatttaaatattgcagcagaagagagaataaaaactcttggtattcttgtcaaaactgattctaaatatcaagataatgttggtcttaataatgaaactgttaggaattctgtaataaaattaatgaggcagggatggagtgctgaagaaatttctagagctaccaaattatctattggggaagttgagcttattttagagcttggtataagtaataaaggtgattgaaggttatatttatgaaggcagatttaaatttaataaaaacattgcaccctcttgagataaaagtaattgtaaataatgaagaagaggatgatatttctgcttcaattattattgaaaaattggggtttaatgaaggtcaagcaaataaaacaattgaatggttaaattctaaagggattattgaagagatttataggaaattaaatgtattttataaagcaacagaaaggggtcttggtgctttaagagatggttttgttgaagaaaaaataataaatttagtatctcaaaaggcagtgttggcttcaaatttagccttagagcttgatattgatgttaaagaagtaagaaaagcctttggtaatttgttaaaagagggcattctttctcttgatttagataaacagattattataaattgtttagatggcacagagactaattatcaaaaagtacgtgttttgttggaaagagcaaaaaatagcgatcttcttagagaaagtttgacaaccgaagagcttttattaatatcaaattttgctaagaaaaaaggagcagactctgtattttttaaaataatagaaaaacttgatttaaagtttagattatctagttttggattggaagttaaaaattttttaatgaaaagcaaattgactggagatgagcttactaagcttactcccgaaattttaaaaaataaaacgtatgagaacaaaaaatttagagcttacaatattcatattccatcagctaagacttttattgggcgtgccaattcttatttagattatatttctaaaattaaagataaattagtaggtcttggctttcaagagtttgatggtcctttggtagaaacagaattttttaacaacgatgctctttttatgccccaatttcatccttctcgtgatattaaagatgtttattacatttcagatcctagcatgcaagaatctttgccagagccttatttttctaatgtaaaattagcccatgaaacaggatatgcaacaggttcaagaggctggagatatagttttagtgaagatctctctaagagattggttttaagaacccatggtaccgttctttctgcaaaacaattaattaatgccaaaaatccaagcagatattttggagttattagatgttttaggtatgatcaagtagatgcaactcacggagtagatttttatcaaaccgaagggattgttattgaggatggtgttagcattaaaactttgctaggccttcttgaaatttttgccaaagagcttgcgggcgctacagaaattaaatatgttcccgcatattttccctttactgaaccttcgattgagatacatgtaaagcatcctgttcttggttggtttgaacttggaggaagtggaatttttagaccagaagttacaaagcctttaggcattgatctgcctgttattgcttggggaattggaatagatagaatggctttaatgcacttaggtctaaatgatttgagagatctatttacttatgatattggtgatgttattttaagacgaggaaagatagatgccaaagttagaaatttataaaaatctttttttagataaaataggaaaaaattttacaaatttagagatttcagaattacttgaaccatttaaggcagaatttgatgggtttgatgagagttcgggaaaaatcaaaatagaatttaatgatacaaataggccagatttgtggtcttatttaggacttgctcgtcagataaaaacgtatttttttggagaaatgccctattatgattttttttcaaaaaagggagattttaagaagttttatggtgaaattttagttgatggcaaaatgtctcaaatcagaccgtttatttttggatttttagcaaaaggattgattattaatgataaaatgcttgagacactaattcaatttcaagaaaaactttgtcagaattatggacaaaagagaagaagaattgcaatggggatgtataattctaattttattaaattcccaataagttatattgcctcatctcctaatcacaagtttgttccctttggaatggattatgagctttctcttttagagataaatgaaaagcatcccaaaggattggaatattcacatattattaaaaattttgataagtttccgttattattagatgataataataatgtagtctcttatcctccaataattaattctaacaatattggatctttaaaggttggtgatactgatttatttgttgaggttacaggtattgattttgaagcaactttgttagcgttatctatagcagcctgtgatttttatgatatgggttttgaaattttgcccgtaaaaactgtgtttagagagccttttaatttagattttaaagaattggtatgtccttattattttcaagaagaagtggagtttaatgttgaaaatattaatagactgcttggaagcaatttaacattagagcgtatttgccttagtttaaaaaaaatgggagtaaattcttattccaaagattttaagaattatattgttccacctttttatagaaacgattttcttcatgaggttgatgtaattgaagatgtaatgataggggagggtctttcaagttttaatccggagcttcccaaggcttttgcagtgggaaggcttagtcctttagaagagttttcaaggaatgttagaaatttaatggtgggtatgggatttcaagagatgatttataattatatgggttctaagaaagattttattgacagaatgaatattaatgatcaaaattttttaaaagtatctaatccaatgacagagaattatgaatatattagagcatcaataattcctaatttattaaaatcagaaagtgttagttctaattttccctatccacataaaatttttgaaattggcaaggtggctttaaagaatctggatactaccgaaggaacaagtacttttactaatttagcttttttaatgtctggtaaagaaatttcttttaatgagattaattcaattgttgcaacacttttttattatttaaatattgagattaatttaatagaatcaaaaaccactttttatattaatggcaggggagcggatattgtaattgaaggttttaatataggtggttttggcgaaatttcaccttatgtgttaaataattttggtatttttattccatgttctgtttttgaggttaatataaacaaacttatgagtcgatcttaagcattgaatattagttttagcaatgttaagattaatattcaaatttttaagagaggcctgaagtttagatatgttggaatttgaaactattgatataaatctaaccaagaagaaaaatctatctcaaaaagaggtagattttattgaagatgtaataattgtaggatctggcccggctggactaacagctgggatttattctgttatgagtaattataaggctgctattttggaaggtcctgaacccgggggacagcttactacaaccacagaagtttacaattatcctggctttaaaaatggaataagtggtagaaatttgatgttaaatatgagggagcaagtagtaaatcttggggctaaaacttttcccgaaaccgttttttctataaaaaggaagggtaatattttttacctttatacagaaaattatatttataaaagtaaagctgttattattgctgtgggatcaaaacccaaaaaacttgaaactcttaaaaattcgggtttattttggaataaaggtatttctgtttgtgctatttgtgatggacatctttttaaagggaaaagggttgcagtaattggtggaggcaacactgccctttcagaatcaatttatttaagcaaattggtggacaaggtttatcttattgtaagaaaaaataatcttagagctattgctatgttaagagatagtgttgctaagttacctaatattgaaattttgtataattcagaagccatagaagtagatggtaaatcttctgtttcttcggttaagatttttaataaaaaagataatgttgtttatgaattagaagtgagtgctgtatttatggctgttggctataagccaaatacagaatttttaaagggatttttggatttggacgaagagggatttattgtcactaaagatgttgttaaaacaagcgttgatggtgttttttcatgtggagatgttagcaataaactttatgctcaagccattactgctgctgctgaggggtttattgcatctgttgagttaggaaattttttaaaatagtttttattaagatgtttttgtttttttaaatgaagtttttatataatttaatgctttagagtagatttaattgtcttttgatttcaaaaattaaaatgcctgtagatacagagacattaagtgagtctatttttccgctggttggtatccttattaaaaaatcagaattttcttttattagcttatgtacaccttttccttcatttcctaaaataagtgcaatttttttatcgtttattttgattttgtttatatcttgtcctttaatatcaccagtatatatccaaaagccatagttttttaaaagatttattgtgttgtttatgtttgtcactgtcattttttttacatattgacttgcgccagagctagtgcgcaaaactgttgaattgtcttttgcgctgcgtttttgagtagtaattacaagatctatactaaactgttctgctgttctaaggattgctccaaagttttggggatcttctatttcatctagaagtaaaatgaaagcattttctttttttttaaatgtttctagtaagttttcaaaatctttggtttgtgtttttacatttttatttttttcaagttttaattttaatgcaaatcctctgtggtctttgtttttaagaattttgtcaagttcatttgtatttattcttattatttttatattttgtgttttagctagctgttcaatttctttagtttttggactttttttttgatatataaagttcaaatcctttgttattttttatgctttcaattattgaattggcatgagttatatacatattatgctttgagtaaatctatttcatcaccatcttttaattctttgcccaagttttcaaaaagtttaatagcattagaatttaaatttttaggtgtttttattttggtgattaatattaaatttccaaacttttcggtttgaagaattggcatccctgcatttttaattaaaatttgttcttcattgtttattccttttggaatgtgtattttaatctcttttgaagcgattgtttttattttcacttcttttccaagcgctgcttgagtaaagcttattggaagcattgcatagagatctttaccatttcttttgaatactttatgagatcttatcaatatttttacataaagatcaccatattcttgattatctggattaacatttcccttgcctttcatttttatttgttggttattatcaatgcctgggggaatgtttaattgaatggtttcttgctttgtaagacttccttttcctttacaggatttacaagggtttgatattattttaccttctccgtaacatttagaacatgttgttgtaactctgaaaaatcctccgccttgcactactcttccgctgccgttacacatgttacatatcgaaggacttgtacctttttcggattttttcccgagacaagaatcacagagcatttgtcttgttatgtttatgttatttttgtacccaaagtatgcattttcaagagatatttctatgttgtatcctaagtcttcaccttttgcgtgttttctatttctttcttgtcctttgtttccagtgaaaaatgaatcaaaaatatcgccaaaatcttcaaagatgtctgaaaatccactaaatccacctgaaaatccttcaaatcctcctccttcaaaagcggaatgcccaaatctgtcgtatttagcttttttattgtcatctattaaaatttcgtaagcctgagtggcttctttaaagatagaggcggcttcttcattcccttgatttctgtctgggtgatatttaattgctatttttctataagctttttttatctcatcttttgaggctccttttgagagccccaaaatttcataataatcttttttcactattttttatcctcgtcaacaacctcataatcagcctctttaccctcttcgcttgtattgctttgtgggccattttcttgttggctgtttgcattttgctgggaagaatctttatacatcatctcagctattttgtaagaagctttttgaagttcttctgttctagattttataagtgaaatgtcttctttttcaagactttcttttaattcttttattttactttcaatagcttctttgtcttcgcttgaaattttttcagaatattcttttaatgatttttctgtttgataaattaaagaattagctgtattttttgcttcaatattttcttttaattttttatcttcttccgcatgagcttctgcatcttttaccattcgatctatttctgattcagagagtcctgatgatgattcaattctaattttttgttctttgcccgttcccatatcttttgcagacacatgaactattccattagcatcaatgtcaaagctaacttcaatttgaggcactcctcttggtgctgctggtattccatcaagtataaaattaccaagtattctgttttgtgctgccatttcacgttcaccttgaaggactttaatatcaacagaggtttgattgtcagcagctgttgagaatacttgacttttttttgtaggaattgtggtgtttcgttcaataagtttagtcataaccccgcctagtgtttctattcctagtgagagtggagtaacgtcaaggagtaccatgtctttagtttctcctgttagaatgccaccctgaatagcagctccaattgctacagcttcatctggatttactcctttgttaggatcttgtccaaatatatcttttacaattttttgaatagcaggaattcttgttgatccacctacaagtattacttcattaatatcagaagctttaagcccagcatctttaatagccttaaggcatggttcttttgttttttgaactaagtggtctaccatttgttcgaattttgctcttgttagagtatattgtaagtgttttggaccatttgcatctgctgtaataaatggaagatttattgaagcttcttgagcgcctgagagttctattttagctttttcagctgcttctttgagtctttgaagagccattttgtcgtttgataaatcaatagcgctttcttttttgaattctgaaattaaatgttttattatttcgtcgtcaaaattgtcaccaccaagatgtgtgtctccgttggttgactttacttcaaaaacaccatctccaagttccaatattgaaatgtcaaatgttcccccaccaagatcgtaaacagcaacgatctcttcgtgttttttttcaattccataagcaagagcagcagcagttggctcgttaacaattctttttacctcaagacctgctatttttccagcatcttttgtggcttgtctttgagcatcattaaagtaagcaggaactgtgataacagcctctgtaactttttcacctaaataagcctctgctgtttctttcatttttgtaagagttgctgctgagatctcaggcggtgacatttgcttttttatatttgaaatgtttactcgcgcatcgccatttagtcctttttctattttataaggaaccatttttatttcgcttgcaacctcttcaaatcttcttcccataaatcttttaatagaataaattgtgttttcagggtttgtaaccatttggttttttgcaacttgccccacaagtctttcgcctttatttgtgtaagcaacaatagatggagtagttcttcccccttctgaattttgtattacaactggttttccatgctccattatagctacgcatgagtttgttgttcctaggtcaatacctattattttgcccatattataaacctccttttttctaattaatttttgctttgagcaactttaactttcgctgttcttaatattctgtcgttgtagcaatatcctttttggtatacttctactatttctggatttttaagaccctctttctcttcaatgcttattgcttcatgacgacttggatcaaagttctcgccattttctccaaatttttttaaattatattttttatcaaagattgatagtatttcattttcaatcatactgattcctgttaataagttatcaaaatctttagatttttttgaagagttaatagctcgttctaagttatcaagaaaattaacgacatctttcattatggtttcatttgcaaatttaacaaaattgtctttttctttttctaatctttttctgaagttttcaaattctgcttgttttcttaaatacaaatctttaagattggagatttcattttcaagttcagcaatttttttatcagaatttactaaatttaagttttcttttttttgagattttgtatttttattatcttgtttgttggttttttcagattcgcttttagtttcttttttttccatttttcctcctttgataaagcattttatctttaaaaaaaatattttacaaatttttttctttcttgaaatttaataaaattgattcattttgagcatttgtaagatgtatatttttcttaagctttcagtaatagtgttatattgatacatattgttatttagtaaaatgttcgtgtgtatttttttgtcaaaataaaaaattttatttttttatttataagaatatttttggtatcattttttgattttgttgtgtttttagtgcttttagacatctttaatattagggtatttttaaaatatgggtgagtattatttttgccaagctattaatttttttgttgtaatttaatgtattattgcttattatttacctatgaaaataagcattgctcaagcaaaatacagagctttagattttgataaatgtattgctgattttaaaattaattattatgaagctttgctaaggggatcagacgttttagtttttccttctatgtttttaggcaatactaagtatggtgagttttttgggctttctaaatattctcaaaatatatgtaagttcattgaatttatgaaagaacaggttaatgataacactttaattgtttttggtcatagtgtttatgagggtggtaaatttgtagatgttatttctgtcatcagtaatcataaagctattctaactgtatcacaatgcaatttgcctgggttttttaggtataaggacaatttatttgctgtattaaattttgaggatgctttgttatttaaagaagtaattcccaaatttggcgaggatttaaagaagcacagtatttaataataccgtccaaatcttacttcactaaggagaagaataatcttaggttaaaattctttcaaagagttgctattgagaataatctagatgttatttattcgaatttttatggagttgaagattctgcagtttatgatgggtgtagcttttttattaatagttttggcaaggtaaagcaagccaaaggatttgaatttgattttatatctaatgatacatttcaagatttaaaatttgatacatgtaatgagctttttgaaaaaattattttagcaatatctcttgttttaagaaaatatgtttctttttcaggattttccaaagttcatttgggagtatctgggggtgttgattctgctcttattgcgtatcttgcatgttttgctttgggcgctgagaatgttgttgggatttctatgcctagtaaattttcatcagcaggttctatttctgatgctaaagaactttctagaaaattaggttttaaattgattgaaatgccaataaaagatttatttcaggtaagcagtagattttttgaaggatattttgatattaaaggtgttactggagaaaatttgcaagctcggttaagagggcttttattaatgtcttatagtaattctcaaaattctttgcttttaaatactggtaacaaaagcgaaattgcagttggttattgtaccctttatggggatacttgcggagggcttgctttgatcggagatctttttaagactgaggtttatgatcttgtaaattatattaatgcaaaatttgaccaatgtattattcctgttaatattattttaaaggagccttcagctgagttaaggtttgatcaaaaagatagtgattatcttccaaaatatgaagttcttgatgttattttaaatagatatttgattggcaatgaatctgtagattcaatttatcttaattttgaaaaaggtatagttgataaagttttaaatctttattttaaaaatgaatacaaaagaagacagggagctcctatagttaaagtttctgaaaaaacctttggttttgagctttcaatgcctattttaaataatataatttgaaattatgattggagcttgagattttgaaattcttttctttttttaaattttattaataatattttttgctggaaaaattgaaaaatagctttttaagttaaaattaagtttttatacctttaaatctgtttaatagacatatctggtcatagtataggatctgcttttttatttcttagtgtattaatattattaatttttatgttgtgacagcttaaataacacaagtcctttttaagtgttaaatcatgtcaataattatttattgaatttataagtgatatgtgtattccattgttgtatagaattttgaatgtaaaaattataaaaatgagatttgttctaatgctttaacttcagttttttaattttaatgggatttaatgggattttggcacttaaacaaaggacatcgtttttaattgggatttatgtatttctattagaagaaagagtttgtgtttgataaattttcttagcttttgatatttaatagaatctttgagattgaaaataaaaaaatgtaagtatagatatttatgatttttatactatgtttagtaaaagttattctaatttggtgcattttttagaggtgctttattgaaaaatatttaatttatcaaagtataatgcttttaaagatgatttttcaattttagaatttattattaataagagaattaagataaaaatggattgggattttgaaaaaattatatttttattaaatgaatcaactaggcttgcattaagtggttgtgctaaattaattttagattttaaatctgatgggtctattgtaactcaggttgataagcaaattgagcaattcttattcaaagagatcaaaaagcctggaaattttgttcttggagaagagacaatatctacttataaagaagagtatatcaaagatgctttaatatcagagagtacttttattattgatcctattgatggaacttcttcttttgcagcaggccttccttcatatggaatatcgctagcgtatgctagtggcggcaaaattattgaaggagccatttctcttcctttaagcggagagttttttattacttctaaagataatgtattttatgctaaaaaaaacattggtagctatcctttaaaaaaggattttaataaatttatttttgataattctaaatgttacaatattcatagtttacttgcagtttcaaggtctattataaggttatttaatcttgatatttcttctcatattcatattaatggttcttgtgtatattcttttgctaaactttttacaggttcttataaggcctacttttcttttgtaggactttgggatattgcagcgtgtttagctattggtaataaattgggcatggttggcgaattttattgtggtaataaaatgacattagatatcttagattcaatgtatattttagagcctaataatcataaaagatggtccttgaaagatttttttatttattctgataataaatcaacaatagacattataagaaaagatgcaaataaaaaaatcaataagtaaggtataaaaaacttgaaaattgttatttatgttttgcggttttgttgttattagattcaatgtcgagtgttttgattagcttgtttaaggtccagcttgaaaattttatgtaaagcattttaaatggattttttgtatttttctttagcacttttaacgattctatattcattaaagctattatttcttttagtgtttttggtaaattattgaaaattttggagcctattttatgtccttctagaatgaaattttgaagagttatttgatcttttttttgtaggcgcctcatatatagcttcaaaatacgctcttgagatttcatgatttctgaattaatttgttcttgttttttagtaatttttttcttgttttcaatgataggttttttaggtagagacttgtaagggtttgttcctggaatataatttttaggaattttcatatattttactcctatttaactagctaacctataattctattattttttttgtttttatgcaatcaatattgatattttgattttttatgattagaatcatcatatgaaggagtttttaagggtaggggcttttaatttattgcttggtgctttaatattgtttgttgttatttttttacaatttagaaatttaaacttaaatatattttttttaaaagatataaaattagaagtaaataataaggttttaaatagtgaatatactttaaatgatctggttgttaatgttaggggacttaggatatttttgtccaagcttaatccacttgttgttttagaaactggtttaaatcttttccccatctcttataaagtgcaagacatgggtatttatgtttattttgagaataatatttttctcggatttttgcttgattcggaaaataattttagcattgaatcaaatctctctaagagctttttgttaagttatgaagttgaagatcattatagagttttattagataagcctactatttcaataagacaaggggagaatttggaatataaaatctttttaggagaaaatgtaaagataagagagaaagatattttgatttctcctcaagcagcatttagaattggcaatgctatttatatcgattcaccaaagaaaaatattccaaattctattatggagggcaaccaaactaataaaagtaatgtattagattattctattgtgcattcaaaaattaaagaggtggataataagatttttaatgatgttttaagcaattttagacaaaatgcttatgattcttggaacaattctgttaattttaatgcttcaaagggaggatggcttaaatacggtgtttatagctttgatgaaaatttaatggtttgttttttagcagaatctttaatcagaggggatcacgagtcaatatttttaaaattagattctttattagccaaaaatgaacataagttgacttatttaagtttatgttattacgctaattcagatcaatttgataaatttttttcttatttatcaaggaataaaacttttattgattctcttgaagaagacaggcttatggtttatttaaaggaagatcctcgtcttttggaaaaaatttttttatcagaaaacggttctaaattaaatggtgctttaaatcttctcaaagatcctaaaaaaatattaagttctaattttaattttaaccaagcctacaacattttatctaattatcttacttttcttaagattagagttgacgattctttttatttaagttttaaaaaggagctttataaatttgtatttactttatttggcgttacagatgaaggaaaaatgtatattttaaataataatattaattcatctgatgttgttgagcatgcattaaagatttctggggttcttaaaagaatggcatcttatttaaaagatagcttaatattaaagctttcattgaatgcaatttattattctttaatgagtgattatgccaaaggaattccttatgaaagctattattctgatattattgataatcaatatatgccccaatttatctttatttctagctatagatctatcaggtggatatatgctgcttctggggttttaaatcgtgaaattactgatactaaagttgcaattgattttgatcaagagattaattattcaagctatatattttttggaaacattttaaatccaactttagttagatttagagaaattgattggtttacagattataagttttacgtatattctgatggttggaagtattatcctttaaacaaaattttggttattaaagcaacgcccaagaaaaagagaacttttaatcttttattgagatttgacaaaattgcaaaaaaaataaatatttatgaataaacctttattatcagaattgataattgatattggaaataccagcattgcttttgccttatttaaagataatcaagttaatttatttattaaaatgaaaacaaatcttatgttaaggtatgatgaggtttatagcttttttgaagaaaattttgattttaatgtaaataaagtttttataagcagcgttgttcctattcttaatgaaacatttaaaaatgtcattttttctttttttaagataaagcctttgtttattggttttgatttgaattatgatttgacatttaatccttacaaaagcgataaatttttgctaggttcagacgtttttgccaatcttgttgcagccattgaaaattattcatttgaaaatgttttagtagtagaccttggaactgcttgcaccatttttgctgttagcaggcaagatggaatactcggtggtattataaattctggtcctttgataaattttaattctttattagataatgcctatcttatcaaaaaattccccattagcactccaaataatcttttagagagaacgacatctgggagtgtaaacagcggtttattttatcaatataagtatttaatagaaggtgtttatcgtgatattaagcagatgtataaaaaaaaatttaatttaataattactgggggtaatgcggacctaattttgtcattaattgagatagagtttatttttaatattcatttaactgtagaaggcgttagaattttaggaaattctattgactttaagtttgttaattgaaatatttgtttttaaagttttaaatttttttgttaaataaatttgggaagttttttgtttggtgattgaaattatctaaaattgatgtaatctcttcatatactttatcattaatttctgctttaaatgaatttacgtttgattctacataattttccttgctaaagcccactataaatccacttaattttgtttttttaagccatgaatatgttaattctaaaattgttaagttatttatctttgctatctcttcaagtttatttatggttttcaaagtataaggccaaatttcttttttgaaaagtatcaatttttctgttctaatatcattaaatttgtttttgtcttttatattagctttagataaaagtccttgagcaattgttgaatatgatatggtggcaatattgttgtcttcacagtaaggaattacatctttttctttatttctaaataaggggttgtatcctatttggtttacgtcaattttgcaaactttttttatgctttccatgtgtgatatttcaaaattacttacgcctacatattttattcttccttttactctcatttcttcaagaaatgatgcgattggtcttaggtcaaaatcggctttaggccagtgtatatagtaaatatctatataatcagtttttaaatttttaagactttcattaaagttctctctatattctgaaatttccattgggtagcatttacttgcaattaaaatattttctcttattgttggatctttttctattatttcgccaattattttttccgaaattccatttccataagctcttgcagtatcaatatttctgatcccgtgatcatatgctttttttaatatttttttagcagtttctttttcgacttgcttaaaatatcctcctccgaattgccaagaccctaaaattaatttgctataagtatttatcttgtctttaagattattcacagattctcctttttattttacgataaattggtatttttgttttaatgatgatttaagtatgtcttattttaaaagttttataaataaaattttatagtttgttaatattttttagcaatttttctttattaaaatctctatttattccaaatctggttaaagagaaatcgtattttacaggatcttcattattttcttttgaaaaatagcttgtaatttttattgcttgtttaagatttacgttttttatttctttgattttaaatagttttgaagcaatgcttgtcatgtgagtatccattggcactataagcttattgggattgaatttattccaaatgcctaaatcgacctcatctttgcgtatcatccatcttaagaataaaaaaagccttttgcaagaacttccctttgaaggctttggaagtagcatgccaaattctctcccatttattttttccatatgctttattaattcatctatgctaagtataaaatcttggtttttataataaatactgtaaagaagattttcaagcgtatggtgctgttcttttattatcttaagggtgcacagtagccttacaatatcttctcctttgaaaaatctataaacgaatcctttaaatatttcttttaagtccttttcatttgccagcttaaggctctcagaaggggatttgccaagtggtttaagtattgtctcgattgcttctaaaattctttctactcttccaagcgacaatgaagaactwataggcctacragttcaatgtcttctttttctttatacctgtatagaaattctaaaggatcaggatgtataaatttttttttattgtattttgaatatatcttttctagaaaatcatatagcgagcttttagcttttatttgcattattatattctaatagttctaataatatttttttaagttttttgtcgtaaagtttgtcttttgcccatttcccagtcaaatcatatattgttggagcagatcctcttttaacaaggtaaaatctaggatcaaccatatttgatttgatattttgttttgaagcataagcttttaaatgttgaatatgagctttaattccttctgtaatattggaaaaagaatttccttttgtaagattattagtagcgcctattmmtgaaaaattgtgttgttcttttgaaactattccattgaattttagagctcctgtttctagtaacatttgagcataggcaatgtcataattaaccccttcaatcaaagattcgtctatataggttttagcaacagtatttacatagtttttgtcaagctctggatttatttctagagtatattttacaaggtcttctagttgagtttttcctctacttattaaaaagggaatatatttttccttttgtatttcagtacttatttcgattatctcttcattactatgagctttatttgttaaaaagatgttgagcattgcaaatagcaagaatttttttatcattattatttttcctcttcaataaatttattaatttcattaactatagaattaaatcttgataacattgattttttgttttttaagaaattaaaactttttaaatagtttctgctaaaaataagatcagaaatttctgcaatattgcttatgcctgttagctttatagattttgtattagcaacttttgtgtggaggttcttttcattttcttttagaattagttgtaagttttttaaatttcttattgtttgcggttctccccctatattgatatattttgctatgtttgtgttttttgcaaggataaaattaacaatatttgcttgatttcctagtgtaattaacgttagtttattaaggttcatttttgaatttaaaaattccaaattttggcttgattttgctagttcaatacatattttgaatatcagtttcagtagatgcaatatcagctttttcattaaggatattggcaggctcaattaaatagctaatgcttttattgattacatagctaaatatacttttatggctatttttaataaaatcgtagcttttcatatgtttatattttggcgaatataaataaacaatttttcctttcttaacaatcctgctaactagagatttgaacattgaatcgtgagaataataaggaagtataagtaaaacagaatcatatagtttttggttattgctaataagggcttttttatatatgttattctgttttgataagtaattcatttcgtttatgaaaaaaggattaaattcgtacaaaagaaatggattttgttttttaaggcccaatgttgagcttacagggtaccaaatcgataagtttaaatcatttttgtgatctttaattcttgcgaatccaagttgatagctattgttttcatctttgggataatttataaaaagtgctaagtatgaaaaaatagttgcaataataacagttaaaatagcaggcattacaagtattgtttttagcaaaattgaaagaaatattccttttgattgttttgtagacctattgttgattcttcttctactatttactattgttttgatgtttttaaagaagatgattatcataaagattaagaatatactgccaatatataacattaacggtctgatttctgtaaagtataaagttattacaaaaaacgtacctggaaatattatgaagtagtcttcataagtaaattcttttttaaaattaaataaatttactattaaaaatatgctaaaactggttaagaaaatgagttcataaatttgcgtatccataaaaataatttttccttaaataattataagcataaaagcaatttttccaaaatagtttacagaattgattattaaatagtgttaatctaattttagatttaataagagttgtttgattaagaaagtttatttttgtttaatataaaatgttgtgttaaaatagattatgtttacaggcgaaaggtagtaacatatggttggaacctttttgggaacgggggcttcaagtggtgttcctatgttaaattgtagctgtaaagtctgtacttcaagttatagtaaaaataaaagattgagaagttctttttttcttgagtcatcttctggcatcaaattgttgattgatacaggtcctgatattagacagcaacttttaagagagaaaatagataggcttgatttagtgctttacacgcatgaacattatgatcatattatgggttttgatgatattaagttctatacacgatgtgcccctttaaacatttatgctagagatactgccatggctcacataaggaatgcttttccgtataattttacatccaaaccctctttaagtggaaaggcagacattattgccaatgttattagggattttgagccctttttttttaaaagtctaaagatagtgccaattcctttgattcatggggatataattagtttaggttatagggtaggcaatttagcgtatcttactgatgttaaatttattcccgaagcgtcttatgattatttaaaaaatttagatctactcataatagatgctatgaggattaagcctcatcctgcgcatttaaatttttcagaggctttttgtgtaattaaaaagatcaatcctaaaatttcttactttacacatattgcacacgatataatgcatgaagaatttgattatttagaaaaagataatatctatttagcttatgatggattaaagatttatatttgatttaactttagttagagaggatttatgaaattaatttcatggaatgtaaatggaattagagctgttttaaagaaaggttttcttgagtttgtaaaagaatatactccagatattttatgtattcaagaaactaaagccttaagagaacagttgccaaaggatttaattcttgaaaattattattcttatttttcaaattcaaagattaaaggttatagtggtgtttgcatttattcaaaagttgagcctatctctgtaaggctgcttggagaagaaatttttgacaatgagggtagggggcttgtagcatgctacgacgattttatattggttaacggttatttccccaattctcaagttttaagaagaagacttgggtataaacttgattttttatcttatgttgaaaatcttgcagattctcttgtatgtgatggtaaaaatgtagtaatttgtggtgattttaatattgctcataccgagattgaccttataagtcccgattctaatagagactctccgggatattatattgaagagactacttggttagatgattttttaaacaaaggatatgtggatacatttaggatatttaataaggatcctggttattatacttggtggagctatagaacaagagctagagagagaaatatggggtggagaattgattattttattgttaatgaatttttcaagagaaatgttgaaaaatctctaattttagacaaagtaatgggaagtgatcattgccctgtttttttagagttggctgatgtagttagctaaagggaggaggctagattgaaaaaaaacattgcaattttttatttaatatttattgttaattttagttttggaattgatttaaatgattttgatttttaccgtagtcttgaaaaggaagaattgatattttttattaacttattaaagagggagcaacttgttttggaaaatagttgcgctttagagtatattgaattagcctataaggcattaaaagaaaaaaatataaatttattattaaaaaatgacaaagaattagcagtagataataatactgagcacttagtgcaatccaaggcatataacaatgcaaggcttatctttaatgctacaaaggatttaaatactttggttcatattggcaaagatggtcttttaaagactttagatgggagaaatgtaggggttaaggataataaatttattattttagattcttttttgaataacgatttttatgatgatgttccaagtgaatatactactattgaaatttataataaaagcattttaatgcccaatttaaataaatttcttctagataagcgcttaaatccttttatttatcttgaagattttaataaaaacgtttacttaaatgatattccaaaattaagcaaagaagagttattgtttttattttatgaactatttccagtttctaagctaaagagtttaaaagattggaatgattttggattttcatctatttcaaaagcattgaataaaatttattctgaaaaaataaattcaataaagaggagtgcaaatgaattatcaaagaattaagaattattgtaaatttacaagcgtttttctattttttttgttttcctgtgtttctaatgagttaaagttagatcaaagtttggtaaaaggaaaacttgtcaatgggctaaggtattatatttataaaaatcaaaccccaaagaatgccgttaatatgggaattgtttttaatgtgggctcacttaatgaagaagataatgagaggggaatagcgcattatcttgaacatatggcttttaatggtacaaaagattatccagggaattctatagttgatgttcttaaaaaatttggaatgcaatttggtgctgacattaatgctgctactagttttgatttcacttattatagacttgatttgtcagatggtaataataaagatgaaattgatgaatctataaatattttgagaaactgggcttctcaaatcagtttcatgaaagaagaaatagatctagagcgaaatattattattgaggaaaaaaagcttggtgagacttatcctggaagaatttatgagaaaatggataagtttttgacaagcggaagtctttatgaatttagaagtcctattggacttgaagagcaaattttatcttttcagccagaagattttaaaaaattttatagaaagtggtataggccagaacttgcaagtgttattgtggtaggagatattgatcctatagaaattgaagagaagataaagaagcaatttgtttcttggaaaaatccaaccgataaaattaaagaagtaaaagtaagtttagacgtagagcttaaggataaatttttacttttagaagatttggaagttggagagcctagtttaatgttctttaaaaaggaaattattaactttgtaaagaccaaagatgaccttttaaatgctattaaaaagtctttattagccgctctttttgaaaatagattttctgaattaaagactgctggggtaaagcaatttaaaaatgtttcaaataaagattttttctcatttaaatcagataacaataccattgttgcaaaatcgatttctttaaactttaatccagatcatttgaacgaaggaatacaagactttttttatgagcttgagaggataagaaaatttggatttacccaaggtgagcttgaaaaagttagatctcaattttacaaatctttagaattaaggaaaaagaatataaataaaacaaattcatgggctatttttcaggatttaatagaaattgctattaatggttctaataaatttgatatgaatgaatattgcgatctttcttttcaatatttggaaaagattgatttaaaaacaataaacaatcttgtaggaagagagtttgatgtaaaaaattgtgcaattttttattcttaccatggaagagcacatcctgttttaactcttgaagatattgacaatcttcaaaagatagctttaaaaagagagttaaagccttatgagaattctttaattgaaggtaaattttttaagaagtctttagatgataaagatattattagagaaaatgagtttgaaaatgaaatttcgtcatttgttcttgaaaatggggttgaagtttattttaaatataatgatcaaaaaaaaggtgtaattgattttagtgcaacttcttggggaggtttaattaatgaagatttaaaacttattcctgttttatcttttgctcccggagtagtatctggttcgggttatggtgattattctgcattacagattgaaaaatatttatcagataaagctgtttctttaagagttggggttggagctcaagaatcatatatttctggaagttcagataaaaaagatcttgaaactctttttcagcttatatattttacttttaaggaacccaaaattgatgatgtttctttgcaaaatgctattaataatataaaagcattaataaagagcaatgaaaatagttctgattatcattttcataaagccattagtaaatttttaaacaataatgatcctagatttgaagatacaaaagatagtgatttgcaatattttacaaaagaaaatattttgtctttttataagaaaaggtttacttatgcaaataattttaagtttgtctttgctggagactcagatattcagacaataaaggcttattcaaagaaatatttgggcaatcttaactttaaagaaataaacgagtataaagatttagattactcttacagtaaaaattttaataaaatagttgtaaggaagggaaaaaattcaactagttttgcctatgtaatttatccttttaaatttaattatttagcagagacctggttaaatttaaatgctttagcggatcttttaacggatgggcttataaaaaatattaragaaaaaatgtctagtgtttatgcaattcaagcctcttttgactccaatttaagaaaaaatgtagattccgatggtattttgtctattttttttactaccgagcctaaggagctggacaatgtcttaaattctattaatcgctatatgatcgaaaggcaaaaaatagattttaatgataaagatttttcttatgttaagaagaattatattaaaaatacaaaaataaattcagagaagaatggttattggatttcaaatatattggcgtcattatcctggtatggagtatttaaaaataattttggtgttaagtttatagagacaaacttaaacaaagatttaataaatgaattttttaagaaaattaatcttgatgaaaaagcagaaatattgctaatacctgaatagtttgtgtttgcttaaaaaacattcttgttttctgggtttgctagaaggcaagaatgtttagtctatttttattagcaagacatcctctaggggaatcgaacccctcttgccaggatgaaaacctggagtcctaaccgatagacgaagaggacaaaagtgagctcagtaggactcgaacctacgacaaacgccttaaaagggcgctgctctaccacctgagctatgagcccaaaagtcattttatgaccatcgaaagtaataatatatttattttccaataatgtcaagttaaattggcataaaattaataatttataccaaaatgtatttaacaatttgagctgcacaggacttgaacctgtaaccagcggattaagagtccgatgctctaccacttgagctagcagcccagtttattaatttgctaacaataagaataagtttttataaattgaatgtcaaggtttgttgttgcttttttttaattcttctagtaaattttttgcctctagattattaggagagattgtaagaattttaattagtgcttcttctgctaatattttattttttgcatttattcttgatcttgctaattttattaatagattttggttattaggagaaaaacgtaatgcatgttcgtatgcaaaatcggcttcattatatctttttagctcataaaaagaatctgcaattaaattataaacttttattattcttgctcctttagaatcaaggctaatgtattcttgaaagtattttaatgcattgtcataatttttttgaaagaaataagcttctcctagtgcttgaataattcttatgtcatgttttttaatgccaagtcctataatcgcctctttttcagctctcttgtattctcctatggctattaagctccatatcaatattgtcctagcatctaagttactaggatttagtcgaatttcttctaacgtgtttaaaatagcttctttaaattttccttctttatatagaagaagagagtcttctttttctttaggcggtgattgtccaaataacaagcttgaattggatagtagaattaaagctatttgtaatagaaaaaaaaatttcattcttctaaatcctccatttcacaattccctttaaacattgctccagaatctataaagagttctttggttttaatgtttcctattaatttgccggttttgtagattttaattgtttttaaagcctcaatatttccttttattttgccatgatttagcaaatgttgacattttatttcagcttcaacatcagctttttcccttagatagattgagtttgatgagtttattaaacccttaagctttccttctattattattggcttattactttcaatatatccttcaaactcaaaatttttttttattacattttgagtactactttcttcgaattctaagctatctatactcattgaaacctctaaaaatgaatgctttaaagttaaagcattcatttttgattgaattttttatgatttttttattattttaatcgtttcttctttggcccaaaaatcttagaagatataagaataaatttataaaatctaaataaagtttaagtgaggctacaaccgccattctgttttttatttcagtgtcgtcttgtagcattttgtccattttagaaatattttgaacatcataagctgttaagcctgtaaatataactacgcccaaaatagatataaggaaattaagacctgagcttctaaaaaacatattaacaagagatgcaataatgattccccataagcccattattaaatagcttcccatttttgttagatctgttgttgtagtgtatccataaacagacattccaagaaatgttccagcagtaattccgaatgtgaatactattgatccttgtgtgtaaatcataaatatagaagataatgttactcctgttagtgctgagtagagcaagaaaagagctgttgcagtattgcttgatattttattaagagcaccacttattgcatatacaagtccaaattgtataagtatcatagccataaatgacattgaatttgagaatattattgctttgattgtttgattttctgaggttgcatatgcaaatactgctgagattaaaagtccaattgacataagcccgaaaactttggctaaaaacttgttttttattagtatttcttgtttttcttgtgttaaatcgatcataataaagcctccttattattttattaagatttgttttgatcgttaaattttttgcgaagttcatcaaatatagtgcttggaacttttccataccttaagaattccattgagaattctgcttttccttgggtagaggatctaaggactgttgaaaatccaaacatttcgcttaaaggcacctcagcctcaacttttgaaaaacttccatcttctagggaacctgttattattcctcttctttgatttaaaagtccaaacatattgccttggaattcagtaggtccttcaagggtaactttcattattggctcaaggattgtaggctttgctttttcataagcctctctaaaagctccaattgctgctaattggaatgcaatatcagatgagtcaacaatgtgatattggccatcattgattgtaatttttatgtcaactattggaaagccaattaatgttcccctttccattgctttttggaaccctttatcacatgatgggatatattctgttgggattactcctccttttattagattgacaaattcgtatgtttctccttctttgtcaagaggttccataaaccctgcaactcgtccaaactgaccagctcctccagattgctttttgtgagtataattaaattcagcttttcttgtaatcgtttctctataggctacttgcggcattccggtttcaacttctgccttgaactctcttttcattctttcaatgtaaacttctaagtgtagctctcccattccttgaattattgtttcatttgattcaatgtcaacataagttttaaatgttggatcttcttttgtaaatcttccaagggctttggccatattatcagcagattttttatcctttggttttacagaaagagaaattactggatctggaataaacattgatgtcattgaatagttgatcgatggatcacaaaacgtatctcctgatgcacattctattccaaataaagcaacaatgtcaccacttcctccaaattcaatgtcttctgtattattggcatgcattctgataagccttccaactttgaattttttagaagttcttgagttgataagttcttgtcctttttttaaaattccttgatagattctcacataagtcaactgtccgtattgtccgtcttcaagtttaaatgcaagagcaacagttgggagctcgttgtcaattttaagatcgatttctttttcattattatttaggtcaagagcggtgttttttatatcatgaggggatggcaaaaatctggttacagcatctaagagcaattgcactcctttgtttttataagcagatcccataaatacagggcataattttaaagccaatgttcctgttctagttgcattgtatattatttcagtaggaacttcttttccttccatgtgtaattccataagttcatcattaaagtcagcaagagtatcaagcattatttctcgtttgctttttgcttcttctaagagatctgagggtatttctttttctattatttctgttccatcttttccttcaaaatagtaggctttcattaatacaaggtctataactccaatatgtttgtcttctaatccaattggaatttgcattaaaacggagtttaagtcaagttttgatcttagttgatcttttacattgtagggatttgctccggttttatcacacttgtttacaaatgcaaggcgcggcacgctatatcttttaagctgtcgatcaacagttattgattgggattgaactcctgcaacagaatcaagaaccaatattgccccgtcaagcactctaagagatctttcaacttcaattgtaaaatctacgtgtccgggtgtatcaataatatttatcggaaaatctttccattcaacgtgagttgcagctgatgctattgtgattcctctttctctttcaagttccattgagtccattgttgcaccaaccccatctttgccttttacttcgtgaattgcatgaattttattacaataaaaaagaatacgttctgtaagagtggtttttcctgagtcgatgtgtgcgctaatacctatgtttcgtaatttattatagtccattagactttgtccctcctgatgatatgtgggtagaagattaactatcttagtaattttacaaaatttttttttaaaaatctatcttatatcgttttatattattaaatatttggaagtttaaactattttatatgaaatttgacagtttgcttgattaaatttgcattaatgtatatccttatattagggaatatatcatttagtagattttgattttattgattaaaactttttatttagtgaattaactcttactttattattatactcctaagataattatttggaggaatttgagttggaaactttaacaatatctaatgagttgagcaaaatatcacaagtagattacgattcttctgtgtctgagctttctgtgttttttaaggatggaagagcttataagtattttaagattgaaccaagacattttagcgcaatatctaaacttgttgaggacagaagatcagttggtaaatatttaacagcaaaacstatttaacaaatatgaccaagaaaagctttaatttgttttttagatagtattaaaagcccttttgcttttaaagcaggagggcttatttatgtttatgactagcttttagagtaataaattttgttttataatcatcaagatggtttatttaattttaaaattcaacagcattgaagttttgtattttgattattattagatttagtgttattttgctgctttggataatttaaatagtataaatagtattaaggatttaagtaaattttttatgtataaattgttgtttattattgtttttgttttgtcttgtagctctatttttaaggaatatcagaacatatcaggtgaatactataagcttgctaaattaaatgaagagcttggtaatgatgagacttctgttttgctttatgaaaaatctattaaatttaatattaatgctggtgatgattcaagttacaattttattttagcttgcattaatttgaaaaaatatgttgaggctgagttgaaacttaattctattataaaagaagatccagaaaatattttgttaatcaatcttaagggatatttgctatttaaaaaaaatgatttggacaatgctttgatttattatttgaaaactctagaatttgcgcctgcaaataaagaggctctatttaatattttttacatttatcatttaaagagtgacaaaaaaaatgcaaaaaaatatatctcaaaatataaagagctaaatcatcctataccaagtggtgcggaagaaatagtttcttctattcttaagagttaatttttaagtttttttgtttactttttgcttgtggtaatctttatggtaattattatataataaggtgtgcaatataaaccctgttttatttttcataaatttttgtaggagagtttgtatatgattaggcttaaagttttaattttgtgtttatttgggatttttgtgttaaatggttttgcagatactaattttgaattcaattttggtggtggggttgcttttcctgttagtcccttttcaagcttttacaatgaggctttagagattaatgcaaagcttaagcaaaatttgccttcagatttatccccaatagaaaaagaagagatagtccaaaatttttccgatttagccaatattgctaaagctggaataagatatggaacttacgctcaatttggcgctaaatttgatgattttgtttctattggatttgagcttttgtttaacattaatcttcttaaagcaataaagcgttcggatggaactgcaaatgaaaatttctcgtttattatggcaataacaccaagattttatacaaaattagatttttttgttttagctttagcgtttttcacaggtcctaagatcaatatagcgacttcttctgcggattctgttttagcagaactgggaacaatgggctgggatattggtgctagactttcattttcttttttaattcttgaagggtactatgtttggaatattaaaaaccctaaattttctgatttcaagtttggaataggttttgaatttggaattgtgtagtttatttaattttatttttaggattatgttatagtatttgtttttgctattaatagaatttttagatttttatttttattattaaagctaaaatattttaatgaccttgctttaaaaaattttagtcatatttgtgtgtataagttttattaattagtaaattaagattgttaagattttctaaaaaagaacgaggagctgggtgaatttacttaaaaagaaatcaataggaattattgcttgtcctgggggtagggtttttgctagtaaaataatagaagagcttgacagaatatttataaatattgaaaatgagattatagagagcatatgccaagattctaaagccttaaaggaagaaatttttaagattgaaaaagttttatctccttttttagaaggacttagtttgtctactcttaaaagcaaagagcctttagaaattcctgtaaaatttgttaaatttgccaatggtgaatttaaaacagaaattttaaaaacaatcagaaataaggatatttttattgttcaagatgttgctaatgcttatgaagttgagataaacagtagcgaaaaaataattatgacggttaatgatcacataatgaatttaatgacaacaatagatgcctgtatgcaggccaaagccaattctgttagtgttattatcccgtcttatccttattcaagacaagataaaaagcattcaagagaatgcttaacagcaagtcttattggaagatttttagaagagttgggcattagacatattttaaccctagatattcactcaaaggctattgagaatgtctttaggaaagtttattttgaaaatttaaatgtttcttatgaaatctttaattctcttaaggatttaatcgacattagagattctaatttagttattgtttcacccgatacaggtgctgtaagtagaaataaattttttgcatcaagccttaagagccctcttgctttgctttataaggagagagattattcaagagtttcaaatgatgttgctgattcaaatatttctgtaaccaagcttttaggagatgtcgaaggcaagaatgtttttatgagtgacgacatgttagctactgggggcactctaattaaggcaatgaaattacttaaaagcatgggtgctaagaagattatatgtgggattagtttgccgtttttcaatggagatgctattaaatattttgataaagcttatgaggagggatttttttataaaataattggaacaaatgctgtttgtcataatgatgaattaataaataaaccttggtatcatgaggctaatgttgcgcctctttttgcggaggcaatatttgcaatttataataaagttggtttgcaaaaaattcttgatagaaaggatgatattcaaaaattgattaccaagggttaatttatgaatgctcttagtattgatattggtaccagtgttttaaaggcagcattagttagttctaaaaatggagttttaagttatattgatgttagttactcagattattttgatgttgatttcgaaaattttgactttaatatatggcttttttcttttaagaaagccatatccaattttaagcctagcaaaatagattgcatttctgttggcggcatttcgccatgtttaattgctttaaattcaaatttaattcctttggaagtgttgcattggaattcctttaaaattaagtcttattttaagggtaagtctgtatttttgccctatgtacttagtacggttgaaagaggaacatattctaaaataagctattttgtttcttgttttgagtattttatttatttgcttacaggaaagctttttacaagctttccaagcatggagtatattccttttatttgggatgatatagagataaaaaaatatgggcttgacaagaataaatttcctccatttgtaaaaatgggagaaaatattggcgttgtaacttataaagcaggaattgaatttgggctaaatagtggaattagcgtaattaatgcgggatcagattatttgaatgctttggtgggaagtggtgcttttcaagaaggaattgtgtcaaatagaatgggtacaagtgaagggtttaattttgtttcaagtacatatttaccaggattttctctagaatatccttattttttagaaggattttttattattgggagaattgttccttttggatatttgattcaattattaaaagacagtttttataaaaaaagtttaacttttgagttgctcttaaaaaaaattgttaaaagtgtcactttaaataatgtatacttttatccaagcaaaattaaactttttaatgatttatttgttttagatccttgtctttgcaaagatctaagtaaaggaatttttggtagtattaaaaatccattagagattggtttatcaatacttgagtttgtatgttttgctttttacaacagattggtagagctaaaagcctgcaataaagaaattttgagcatttttgttagtgggtctaattctgataatttgcttttaaatcaaataaaggcaaatattcttggcaaagatttaaaaatttttgattttaagcattcagagattattgggggagcaattcaagcattctattctttaagagaatttggcagcttaaatgattcttttttaaaacttacaaagattaagcatgttgtttcgcctattattgaggttcatgaagaatatttagaaaaatatcaaaaatatattaataattatagtctatttgttaacgggtaatatataagtttctttaaattcacctattcctgctatttttttaaagtctgcttttgcttctgattttgttttataaggaccagatcttactctgtaaatatctttattatctactgttgcagaatatattctagcaattatattatatttgagtaatttttgaatatagttgtctgcattgattgggtctgagagtgatacaaattgtatgtaatattctatattaggatcataaatgttatcagtatttaaagttttttgggctatgggttgaggcttttcgatggtttttgatttctgagaagtattagatattttttgagttgtgggttgaggcttttcgatggtttttgatttctgagaagtattagatattttttgagttgtgggttgaggcttttcgatggtttttgatttctgagaagtattagatattttttgagttgtgggttgaggcttttcgatggtttttgatttctgagaagtattagatattttttgagttgtgggttgaggcttttcgatgatttttgatttctgagtattaggtattttgtttgtaggttttttttctttatttaaatcttgtgttaaatctataattatttcattttgagtttcagatacctttaaagatttttcattttggtcaaccttttctaaggtgtttggatctttatcttcttctaaaacaatatttttttctgcaatgtctgaagccaaatttttgtttggaaagaaaataattgtcccaagaaatattatgatacaaactgttgcaattgatgttaatgctacaaaaaatcctttattattatcattgttttcattcaaatctttcatagttaattatcccctgcatttttttttcaatttctttttctagatatgcataattcttgttattaattatattgattatttttaagtttataatatttttttcaaaaaaaatatctttttggattttgagtattttattaatcatatttgaatcaatgtttggtatagaatatgataatctattttttattatagaattctttgccttaagcacaattatgtagtcgcaaagtttttccaaattcattttaaaaagtaaagcagcattaattattatttttgtagattggttttggattaggattttttttattttgctgagtatgactgggtgtgatacgctttcaagcttttttaattctttattgtcattaaatacaagatttcttagtaagagtttgtctatttcatttttagtatttaatattttttgaccaaatattttaactatttcttcttttttttcatgtaatactgaatgtccaagcttgtctgcatttatttcgtaaaatccatatttattgctaattatttttgaaacagtatctttgccagatgcaattcttcctgttactccaatgattaatggatttctccccacgatttacccgtttcaatatttgctcttaaaggcagatttaatgtgtaagcagtttccatcataatttttaatatttttttcacttcattttcttcttcaataggagattcaatgagcatttcatcgtgcacctgtagcaatatttttgattccatttttttacttttaaattcattaaatactttgaccattgcaattttcatgatatcggcggcacttccctgaattatgctatttattgctattctttcagcggcagatctttccagataattattgctattaatttcttttatatatcttcttctttttaagatggtttcgctatatccagcatttcttacgaagtttatttgatttattataaactctttgatttttggataagaatcaaagtaagagtttataaatccttttgcctcttcttttgtaattcccagttcttttgcaagtctaaaatctgacattctataaattattccaaaattaatagattttgctattcttctcaagttaggagtaatttctttttcttctattttgaaaagcttagaagcagtttctgtatgaatgtctttattattttcaaatgctttaataaggacttcatcttgtgataaatgagcaagtatagcaagctcaatttgagaataatcagctgaaataaaaatatttccattttctggtttaaatgcttttcttatttttcgccctttttcatcttttattggtatgttttgcaagttagggtttatgctagtgattctaccagttgctgtttttgtttgtataaagcttgtgtgcagtctgtttgttttatagtttattagttctatcaaattatctgtgtaagtactcttcaattttgcaatttgtctgtattttattagattttcaattgattcatgctgttctctgagagattcaagcacttttatatcagttgaatcttttttcattttttctggtaattttagatttaatttttcaaataaaatttcatgcatttgttttggagaatttagattaaaatcaattcctatgctttttattatttcgttttcgattgcttctaattcttttccaagttcttttccatattcttttaaatattctttatcaaggtaaattccattttcttccatttctataatcaccttgttaaaaggcatttctatttcgtgcattaacttgtcgagtttgtcttcttttaattttttggtaaatatattaaataatctaaatgtaatatcagcatcttcggatgaatagcttgttgccatttctaaagatatatttgcgaagttgtcatttttttgtatcacatcttcatatttaatgtttttatgcattaaatatttttctgcaagaaaatcaagcgatacttttgagtttgtgtcgataaggtatgcagcaatcattgtgtcaaaataaggtggtatagggttaaatccattgtttttaagtattttatagtcaaatttataattttgaccaattatttttggatttgattcaaaaagattgttaaatttttgtattatatagtttttttctatgtaaatttttcctttggcttcgattggaatatagtaaccttcaaattctttaaatgaaatagaaatcccaattaattttgctgtgtaagtatcaagcgaagacgtttctgtgtctattgatatgtatttagcctttttaaggctttctattaaatcatcaagctctatttttgttgttattgagcggtatttaacattttctgtgtcaattgtatttatgtcatctaagctgttggtagtaggttcttgcttaaatagacttttttggtctgcattttctttttcttgttttaagatatcctttttataagtttttattagggcaattgctgagtgcttttcaaacaaagatattatctcttcgctaaaattttttaaggcgaagttttcaatttctggaatttttaaattttcttcaagacttacaagttcatagcttaaaaaagcattttctttttctttgattaaaagttctcggtgttttttatttattatttctaaatttgaatatatcccgtctaaggttttaaattctcttaataaatttgctgctccttttgcgccaatgccttttattccaggtatattgtcagacctgtctccaacaatagctaaataatcttttatttgaaagctatttactccaaatttttttgttacgtactcattatccatttcaataaagctgttgttttcaattttaagtatttttacgtactctgacattgtttgcagcaagtctttatctggagaaataatgtaagttaaatagttattctttgcagcctttttggcaaaactagctaaaagatcgtcagcttcgtagccttccatctcaaagattggtatttttgcctttaaaaggccttcttttatccatcctatttgaggtattaaatcgtccggaggtaaatctcttgttgccttgtagcttggatatttttgttttctaaaagttggtacctctgagtcaaaggtgataatcaaatgttcaggatttttttcttttattatgaaaaataatgttttgaaaaagccaataaatgcgtttacattttctccttgtgtgtttaaaagtggataatttttcattacgtgataatttctaaatattatgtttagtgcatcaattaggtaaagttctttcatattttaatatctaacattatgggtgaattgtttactgcaaggttttggagctttttaatttttggaatttttctttttgcatttgcaatttgttgtaagatttcacaacaaatttgatatttaatgtatatttcttcttttagtagattaatttctttaattaagtaatcaaaattatccaatttttggtttttaaattttaaccatgcatttattgttttataatagtttttgattgattctaatattaaatctttcttaggattggttatacttaatatttctatttcttctctttgcaattcattactttctattgttaatattaatttcaattcttttaattctaataataaatttctaaaatgtttttttaaaatttcattagccgacaatattgattcctaatttactttgagtaacattattactttgagtaatattattttcttttttgcttaattttttccaggcaaagcttaatatttgcagttgttttatgacattgtcaattttgtgtatttcttttttcaaaagaacattttctagctctttatttagaaacaagtatattgagagtaaatttgtagaaatgtttccgccttgctcaaaatttaaggttgacattaattcagtaatgatttcttgtgcatgaaagattttttcattagctttaactgcattttgccaattttcatcttttataagctcttttgcaacttttaaatcctgtattgctttctcataaagcattatcaatattgataggggatttgatgtgtttacttgtgtttgtttgtatattttttcttttgctatcaaaatttcctctaatccaaaagtttaatttgctctattatttgttcttttttaaaaggttttgtaatatatcctctagctccaagagataaagctttttgtattaattcttgttttccaatagctgtaaccattaatatattaacttttttaagcaattttttattaatttcatacattctctcaagagctgtgattccatccattcccatcattgttatatcgagtgttattaaatcaatattattttgtttttcaaattctttaacagcctgaatgccatcttcggcttctaaaaattctttaaatcccaattgacttaagatttttattaggttttttctcataaaaagtgagtcatcagctattaaagcttttttgctttcttccaaactagcactccttttatccattctagcatattaaaatatctttaacgacaattaaaatataattcacatttttataatattgtctttttgattgatatttttctttaaagattattttaatttgaacataaataaaatagcatgtatttttggtggtattttacagtttgtatagtaaagtcggtttttgcttgttagaattgtttgataaaataataaagaatatgttaaattttaccctatgagcagcaaagtacagcaagaaattgcagacttgaagaagttgattagaaagtgggataaagaatattatgtcgattctttgcctagtgttgaagattttgtatatgataagcatattttaaggcttcaagagctagaaagtaagtaccctgaatataagaccttagattctcctactcttaaatttggcagcgatcttttaaatgattttaaagaggttgaacattctgcacctatattaagtcttgataaggtttatgatcttgatttgctaaaatcatggatagataagattgattttaataattcttttaacatttctgttgagccaaagattgatggatgttctatcgttctttattataaagatggcgttcttgaaaaagctcttactagaggtaatggaaaatttggtaatgatgttactataaacgttagaaccattagatatatacctttatttcttgatgaaaaggttgatttagtattaaggggtgaggtttatattactaaagaaaattttttgaaaataaataaatttttggaaaagccttatacgaattctagaaatttggcttcgggaatacttagaagggttgatagtagagaagtcgctaattttcctttaaatattttcatttatgattttttgaatgctggattagaatttaaaaccaatgatttagctactgcaagacttaagaaattgggttttaaagtcaatcccttgattaggttttttgatctaaaaaattcaattggagaagttttaaattacatagcagatataacaaaaaaaagagattcttttgaatatgaaatagatggtgttgttcttaaggttagtgattttgctttaagagaaagattggggtatactgcacatcatcccaaatgggcaatggcttacaaatttgaagcgctttcgggttttagtagggtaaatagcattgttgttcaggttggacgtagtggtaaaattactccggttgctaatattgataaagtttttgtttcaggagcttttattactagtgcaacgttacacaatcaagattatataaggtctattgggttgaatgttggtgatgttgttaaagtttcaagaagaggagatgtaattcctgctgttgaaatggtgataaataaattttcaacaggatttttcaaagttcctgataattgcccagcttgtaaaacggctgtagtaaaagagggggcacattttttttgtccaaataataattgtccttcagtagcagttgagagaataaaatatttttgtagtaaaaattgtatggatattgaagggttttccgacaagataatttcttttctttttgaaaaaaaatttattttttcagaaattgatctttatacttttgatttttataagcttcttgaatttaaagggtttaaagatagaaagataaataatttgataaattcaattgaagctagcaaaaaaaaaccatttagtaaattacttcttagtatgggaattaaagatttaggggaaaatacaataaggttgttgtttcttaataatttaaattcattttcaaagctttttaagctttgtcaagacagatattttgcattttcaacattgttgaaaattaaaggcataggagaaaaaattgctttaaatattattgaagcttttaatgattcagtaatgcttaataagtttaaattttttgaaaatttggaatttaaaatggaagaggttgttgcgattgatggtgagaataagttattggccggtaaaaagttttgcattactggaacttttaatggttattccaggtctattattattgataagctaaaaaataaaggagcaatttttaatacttgtgtgactgggagtttagattttcttattgtaggagaaaaagctggatcaaagcttaaaaaagctttgagtttaaatataaaaattatgtcttttgaagacataaaaagttacttagattagttggataaaagtgtttatttttatttaattatttttatttgcttaaattcaggctttagatttttatacataattcctagttcgtggatatttttgacttctattaagtttctaaaaaattcttctttattttttagaatagggttaatgaaatatttttcaaatttatattttgagattatttcatgattttttaaagcctcatttaaattgttagtgggatctatttcaatatagtatgtgttttcttttttaaatgcaaattgatctcccttttctttaaatttataattattaagatatatgtcagggtagatttgaaaatctgctgtttttatcatagttgtttttggggtgcttttagtattttcttctagatctcggctttcttttttttctatgggctttaaatattccttttttaatttcttattttcttctaagtcgtcatttttacttgtaatgcttggagtgaaagtttcttcatttaagggtttttgataaatttctttttttttaaaattgtttaattctttttgaagttttaaaatagtctcttcattttcctttattttatcttctaattctttgagtttgtgtttatcagttcttatttttttttgattttctttgtttattgcttcatttgcgctgatttttctttttagatcattaattattcttcctattgaagataaattttcctcaatttcttctaagtttttatctgagttatctttttttttaaaattccttaattctctttgcaagtctaaaatagtgttttcattctcgttgattctgtcttcaagttcatcgatttttttttcattaatagcataatatttttcgttttcattaagattttcttttagattgtttattattccttcattagaagggtaattgtcctcatttgttkcttcaatttcatcattatattcataattgtcttcaaaatcatcatcagtttcttcttcaatgttttcaatatttattttttcgtaattttcatcttctttaggcttgatttttttgttaaggagcttttttatttctactatttcgttttttaatttattggttaaaatttcatatttttttgcttttttttcgattgattctatttttttattttcattttccgatgttttttgatttttggtttttaaaagcttttctatgtttttaattttattttcataattttcaattacagattttagatcattttcgtccattcttttttggggtagttttttgtctcttatattttctggcaattttagatctttacccttttttgggtcttcataagaaactatgtttttgtttaaatgttttgaggtatttatttgatcgcttttattcccagaacttttaaattcttcacttaagtcttctagaggaatttcaatgctagagtagcttattgtattattattagccccaaataatgatatacatgaaagtattataaaatacgtaaggcttcgattttttgttttattcataaggtccttgtttttattcagaaaacatctataatttataatgttagcataatttgtccatttatcaaaagagataaaaatagccgggggctatttttattgacaaatagtgctgttttcaaattagttttaagtgaattttttattaatttattttaagattgttgcatgtattgggtagggtcggatgtttttgaggttttattttttaatcctttttatttatgcaatgttaggtttttactaatttaatttttttgtttggtggagtttttgagtttaacaaatgtggatgcgcatgaattttgggctttgccagtttgctgcaatgttaaagattcttttattgaagattttagttttgtagatgaacatgtaaattcaatttttagcatcagttataaagataatataactttaaagtttagagattttgttgattctaatgaatttaacttgaagctttttgacaataaaataagctttgaaggtcaaattcctttggttttgtattcagacaatttggattatttactaaaagcagaaaaaagtgttctttttaatctaagagttggtgatgcgaatagtagttattcttctggatttacaaagaaagagtctggaacttgcaatgttttgaatgcttgttatgaatttagcgattacaatagtttttcagatgattttattttagttaaaatattttttgattctgaaaatttaattattgatgctaatgtagacaatatttcttttttaaaattttttattagtgaaaattttggtgtaagtaaagacaaaataaaaataaattctcttgataattactggtctagctctattttccctatttcttttaatgcaattttacaaggcattgtaatttcaaaaaagattaataaaagggttaatattgtttactacaaaagacattttggaattttagataatttaaatttaactttttcagtttctaattgtttagtggcggataataagctctcaaaaattattttagaaattataataaatagacctttaaattttttatataagttttattttaaatttattaataatattttcaaaaatttgttttttgatgggtttttagaaattttttttgttgagaataaaagcgattttatctttttttatgacaatcttttggcatttgagacttctgtttataattttatttattccaatttttataatcttgctttgtcgatgtcttgtgagccaataggttatttgcttacacagattaaaggtgattatgctagttttttaaaaatttttaaaaaactagatttaaaaaattctttaataaagaaatctgccgttttaagtgttaataaggattatgacatttttgatactagtcgaaggggagttggttttgcttatttgaattcaagtgcttattttttaagcgaagagcaatatgttgttgctttcttatacaaggatggattaaatgtatttttgccctacagtattattgacaacaatttaagcaattatttgaaaaatagtttggctaaaacactgggcttgccttatagcagtgtaaattttttgataggcgagagtgtattagattttggtaatttttataaccttctttttaaagatccttatttaattgaaaaagcaattttaagtattaaggacaatttttcttctttgatagattcagattttataaatgaatatcctgtagtttttaaggaaaaaatagctattagcgatgttaatgattgtgtgcttgggtgttctgttgagcttaaatttgaattttattctcttagcgctgtttttagcaatgtgagcttttttgtagaacaaggcaaatttactaagcttaagttaaataacaagagaattcgcacaatatttggattagcggttgattatgtattttgtcgtgctaatgtaagttgcgatattaaagattgtttaagcttagagtttattgaagatggcgagtttattttttcttttagaagtgtttttattgtttctgtttctgcaattcgaactgctttgattcaggtatttgattttaatgcaagcaaaacgccccttgattttgaagaaattttaaatagttggagtataaaaattgacattaattaatttcaacttaaatggagagagtatttcaaaaaagattagtctttctttggggaccagaaatcttttggattctattttttttgctaagagcaatagtttggagtacattgttaataacagattttttttaattttattggatttcaaacttgtttattctgatttaattcccgcttttattttaaatggtcggaatgtagttacccttgaaggacttaagaaaaaaagtttttataagcacatgcaaaagattttattagaagacgattttaatttttgtagcaattgttttgaatctaatattttgctgttttattactttttggaaaacgagattgtaagcaaatcagatattttaggctatagaaagtcattaaaatgtaattgtatggatgttaatacttttttatctctttatttgaaagctgaagaattgtatagaaaaaatggctaatgttaaggtttattatcctgaaagttttaatatactatctaatttatttaacaaaaatttaaataattatatcatttataatgagctggattttaaaaaaaatcctgatttgtttaatagagaaacacccattgataatttttttattgttggtaattttgaaaaatttaataaggtatctttaaggggtaattttcttgagatggggccttgtgtgacttacaacgagatacttcggattggtaagaaaaatattccaagtttgttttatgaatttatttcaaaatttaatgataaaatatatttaaatagtattaaccttgcaaatgggttttattataaaaacaccgtttttgatatttatcctttgttgataagtcttgatgctcaaattgagtttaaaaatgttttaaccaaaaaaacttatgtttttagtgcttataatttaaatagagctgaatatattgcaaatcgaaacactgttcttattactaaatttaaatttccaatgatgaatttatggaacagaagcttttatcataaaatatttttcaatactttgtcttttgacattttagaagaatcggacattatttttatatgtattcttttaaacataaaaagagacattataaatgattttttgttaaagatattttatgatgacaaggtgatagtcataaaggatttccagattttacttttaaacaaatctttgccgctttcattttctgagatagaaaattctcttaaaatgttggataaaaatataagagattctaaaaatttcaacataggagagagaaatttaaagctaataaagaatttttatttagacatattaatgagttttaatttttaattgttagaataagtttaattactatctttattatgctatatttcttatgtaaagggaatatataatttatttttatgtattataatgtaaaaagttaatcaaaaaaaacaatattcataatgaggggtttctgtacttatggtaaaaaaagaagcaattattaaggctgtaaacggtttgcatgttaggcctgcatcaacttttgtaaaaaaagctaaagagtattctagcgagataacaatagaatctgatggaaagtctgttagcggaaaaagtttgttcaggcttcaaactttggaattatcatcaggtaaaaagcttttgatatgtgctgagggtgaggatgaagagattgctgcttcagagcttgcagagcttatcgaatcttttaaggaatgaattttagaaggatttaagttatgactttatcgggcaaaagaatatccaaagggataggcattggggaagttctttgtattaggaaaaattttgataaaattataagtagagaaaaaatagacttttctcaggttgatagcgagatatcaaaattcaataaagcgaagtcaaaagcaattgaagcgcttagggatcttgagagaaaagctatgcttcaatttggagatgataaaaaaggtatttttgaaggtcaggtgttgatcgttgaagacgatgaacttgatgagcttgttattgagcttattgtaaaggaaaattatagcgctgcttattctatttatttagcgtttgaaaatttggttaaaagtgtagaagattataaagatccttatttaaaagaaagagcgtctgattataaggacattagaaatagattaatttctatcattttaggccaagtatccgatttttctgagattaataaagatattattcttgttaccgaggaattaaccccatctgataccatgcaatttgacttaaattatgttaaagggtttttaactgctgttggaggagaaacctctcatgctgctattttagcaagaacaatggggcttccagcgcttgttatgactttgtcagatattgatgcgttaaaggatggtgataaaatagtaattgatgcaatgtcttctattgttattaaaaatccttcttctgatgagattaatctttatgaaggtaagattttgcgacaagtagagttagaaaaagagcttttttctttaaaagataaagatgctgaaacaaaagatggcacaaaggtgtttttaaaggcaaatattggaacacctgttgatattacctatgttaataaatatggtgttgagggaataggtctttttagaacagagttcttatatatgagatctttacaacctccaacagaagatgagcagtttgaaacttataagagagttatagaaacaatggaaaagaaaggggttgttacgattcgtactcttgatgttggtggtgataaagaaattccttatcttaattttaagaaagaggaaaatccctttttgggctttcgggcacttaggatgtataaggaatatgaggaattaatccaggcgcagtttaatgctatttttagggccagtcattatggtaagataagggtaatggttcctatgcttaccatatatgaagagatcgaaacgatagaatattttgttaataatgcaaaaatcaacttaaagtctagaggcttgccttttgatgaaaatttggaagtgggttgcatgatagaagtcccttctgcagctttaatttcctctaaacttgccaataaattgaaattttttagcatagggactaacgatttaacccaatatgttttagctgttgatcgtggtaatcaaaagatatcaaatttatatgacaagtataatcctgctgtgttgaaattaatcaaaaaggttcttgatgatggggttagttctggaattgatgtgtctgtttgtggtgagcttggaggagatgatgctggagcactgcttcttgtaggccttgggtttaggtctttaagcatgattcctagtgctacgcttagaattaaatatttgcttaaaaagtatacaataatggaattagaagaattggcaaataaggttttaaatagtgattccaagcaagaaactttaagttattttgataaatttataggagattagttatggggtttttagatttttttaaaaaaaccgctacattggatttgattgctccgattagtggaaaagttatgtcaattgataaggttcccgatgaagcttttgctgaaaaaatagttggcgatggaattgcaattcttccaacaagcaatgagttgttggcgccttgtgatgggaaaataggtaaaatttttaaaaccaatcatgcctttagccttgaaactaaagagggcgttgaaatttttgtccattttggaattaatactcttaatttaaatggtaagggttttacaagagttgctgaagagggcattaatgttaaacaaggtgaagttattattaggcttgatcttgaatatttaaaagagcattcagaatccgttattactccggttgttattgcaaattctgatgaagtttcaagtatagaatattcttttggaaggcttgaaaatgattctgaatatattttatcatcttcaactgtcttgacagaagaaattaggcataaaatatctcaaacaaagcctgttatagcgggcaaagatttggtgttgcgagttaaaaagtaaaaagagagagcttaaaactctctctttttacttttaattataagaagtctttttctataaattcgtttattatatttataaattttcctggatttttgctgggcattcctgaagttaacatagcttcttcaaaaaggagaatgcttattttttctaatttttcaggctctagattttttaaattttggactattttattattagggtttaattcaagtattggttttatttcttttacttcttgtcccattgacagcatgattttttgcatttggtaagttggatcattgctatcaattattattgctgaaggctcttttatcaatgttgctgatagattgacttcttttatatgatccttgaggatttcttttacttttgtaagggtatctttgaattcttcttcaatttttttgaaattttcatcttttaattcattgctggtttcgtttttatttattgcctttagttttaatccttcgtattctggaattagatttaaaatagcttcatcgagttcatcgtccatgattaagatttcaaatcctttttctttataagcagctactattgggttttcttttaatatattttctttaccgcctgttatgtagtaaatgcttttttgactctcattcattctttctttatactctttaaaagacacaaacccatctacacttgaggatttaaaccttattaatgatataagcttttctctgttttcaaagtcagaataaacaccttctttaatgcatctcccaaattctttagaaaactctgaaaatttttcaggattttttttacttagcttttcaagctcgcttagtattttttttacagaagatgattttattttagacaaaattttattttgctgtaaaatttctctacttacattgagtggcaaatcttggcagtctataattccttttataaatcttagatagtttggaagcaagctgccttcagaatctgtaataaagattctatttataaatagctttaccccaggcttagtgtttgggtaatataaatcatagggagctttgcttgggacgtaaaataaattagtatattccaaatttccttcggcttttgtatgaatatgcattaatggattttcataatcaaaggttgtatttttataaaattcattgtattcttctgctttaatttcgcttttattttttgtccaaagagcagtagtttcatttaatttttcttctttttcttctattccctcttgtttcccgtccttcattataggttcgctgtatttaatataaatgggataatttatgtgatttgaatattttttgataatttcttgaattttccatttattagcatattcaaggccttctttattaagatataactttatttctgtacctgactcttctttttttgctttttctatttcatatcctgttttgccgtcgctagaccaaatatatgcgtcgctttctaatgctttttttgatgtaacttctactttttctgatactatgaatgcgctgtaaaatccaactccaaactggccaattaggcttgcagattttttttcatcttgttttaaattgttaataaattctttagttcctgattttgcaattacgccaagatgattagttaaatcttgttcatccattccgattccattatctttaattaggatgcttttatcatcaaacgatatttctatttttggttctagagcaatgtttttgaatttttcgtttgtcaagcttaaaaacttgagtttatcaatggcgtcagacgcatttgatatcaattctcttaaaaatatttctttatgggagtaaagagagtggatgattaaataaagcaaatcatttacttctgtatcaaattgttttttcatgcaacttttccttttcaatttaatctttactttttttataatataacataatctaaaaataataaataaagcaatttgtttaaaatagaaaattagaatcaaggagaatgcaatggatgtaggaatttatggacttggtgttatgggtagtaatttagctctaaatattgctgataacggttttaatgtttctgtttacaatagagataatgaaaaaactgaaatttttgttaaacaaaattctcataaaaagataaatggttttaaagatattgaatcttttgttaaaagcttaaaaactccaaaaaaaatcatcttaatggtgacaagctctgctatagaaaaggttattgagcaaattttaccctttatgaataaatcagacataattattgatggtggaaattctcattataagagcacaatgagattggaaaaagaattgtttgctaaagacatttattttgtaggacttggaatttctggaggggagagaggagcaagatttggtcctgcgctaatgtatggaggaagtaaatcagcctatgaaattcttgagcccatgttaaataaaattgcagctaaaactaaaaataatgatatttgttcgacttatattggggagaacggttctgggcactatgttaaaatgatacataatggagtggaatacgctgatatgcagcttatcagcgaggtttattttttcatgaaaaaagctttcaatttagataatttgaaaatttctgaagtttttgaaaaatggaatgaaggcgatctttcagggtatttactagaaataacttctaagattcttaaatataaagaaaataatgaatatttagttgataagattttagatattgcaaatcaaaaaggcactggtgtttggacagctattgatgctcttgaatctggtgtgcctgtaaatttaattgttgaatctgttttttcaagatttatgtcggggttaaaacacgaaaggattattgctagcgatttacttaagatggatacttcttcttttgagtttgagcttagtgattggattttagatctttattatgctcttttagtttcaaaaatagtagcttatgctcaaggttttatgatgcttaagaccgcgtctgtgaattatggttgggatttgaatttaggtaaaatttctttggtttggagagaaggctgtattattcgtagcagttttttagataaaattaaattggcttatgataaaaatcctcatcttattaatttgctttttgatgattattttttagatttactaaaaaataatcacaaatctttaagaagaataatttcaaaggctagtgaaattgggattcctttgccagcattttatgccagcctttcgtttttagattcttattctactaattatctgccttctaatctaattcaagcacaaagagatttttttggtgctcattcttttgaaagattagactcaaaacgaggtgaattttttcatagcgcttggcaataaatttaataaattagaatgaattggtgttaaaagatatagtacttagcaaatattcccccagcaaagtttgattttatgcccgaataggttctatgttgagcaagagaccttgtatttgagatgaattctattgaaggtgctattttcatacctatttctaaattttctgtaatgtcgtaaaaaataaccaatggaattctcattccaaatcctaattctacatttattaatttagatgtgtgagacgatatgcttatatttcctcctattccaattcctaaatttaaattttttatcaaagatattgtaaaaatgaaatcaagtgctgctattgctaataaattaaaatcataaaattttgattcaagtttggggcctgatagatttattccattactaccaccatagccaatttcaaaatcaatgaaaggaaatgacattattaagttaataattggatttccaatgcttgctccaaagccaattcctctatttaaatatgaatcttttgtaaaaccatttgtagatatgtttgcaatcatgataaacaatataaaaatttttttcaccgttgtctcccaaattttgtcttattattatattttatttttgaattttaaaacaataaaaacaagaccttgcccttaaaatcttatgtttaagtttttgggagctcggtttgatttttcaacaattgttcttttttaaaactttttaaaaaagaattttattattaagtaaaccagaatcttagtcccaatcctgcgaatacttcccatctaaatccaacgccattactccaaacattcattccaagtccgggtgctattcgtaaaaatatgtcgaatttcttcctaaatactgcaatatttaaggccaaaggcaatcttgctccaatgctcattggtcctgagcctgacttactgcctccaaatcttgaaaaccatattgttccatatccccctgcgccaactgaaaaatccaaaatattagcagctcccgggaatgtgtatatgtagaaaatatagtctaatgctataaataatgttttccagtctgaaaacaaattatttactccgctgtaaagaccaatgtcaagatcaaagtttcctatattaatctgtagagcaattggtaatggaagtataattcctgctccaaatttaccccttgcagattcttttgaattagaaaatcctgagattggggctaataaaataataattgtcataataattatttttgttctcattgctttattatctcctaagtatagcattctagcctttaaaagaattttagtccaataattttttttatctaaaaagtgaaaactatatcttaagagagccttttattccaatagaaaagttaccttttattggaaatattaaatttccgttaggcatttggccaataaaaattgatggtgttgtttttattataatttcaataatgtcataataagcttcatatattattcccaagggcaaacccactccgattttataggtaatcccagaagaaacatttgttaaatctgagcttgtaattttgcctatttcaaaaaataggctagatcccaagaaaaagataaaatttgaatctttaaattttaaatttaaaaatatatagtcacaatatattttaaataacaatgctattggtgattttggaaaaaattccgagacactcaatattgttacccctactccaatatcaaagttattaatgctgaattctattgcagtagggtaaggtagaataaaaccaaattttattttagtttttgcttttaagctttctatttttggatcagttgtactgttttgtccagttatattgtttttagatttttcgtttgtaaaaatattttcaacattgaaaaataatgtgataataattattaataatctgattagtttgtttttactttgcattgttaacttttttatattaaatttaatttaacctacaactttctaccttaaattataagatagaattctgttaaaattatgttttttattgtttttggtaaattaaattttattaacttctaatttgtatttatcaatatatgaggtaatattaatcttgatattagcattctatttgcgatttaaattacattcaaaggggcgtttatgagcacagattcagatgtgcaagattctttaagtcagtatcttttatttagtttggacgaactttatgctattgagattaaatatgttgttgaggttttagaatatactaagatatcaaaaatcccaaggactcccaattacatggcaggaataataaataataggggcaaaatcgttccaataattgatattcgaaaacaatttggaatgagcgatcgtgctgttgatgaggatgataaaaagaggaataagggagttaacatttcaaatattattatattgaatttggtttacgagggggatgaatttaatcttggaattttagtagattatgtcaatgaagttcttgaattagatccatttagtattgatgatgctcctaagattggatcagggtttaattcaaaatttatttcaggaattggcaagagtaatgataagtttattattattttaaatgtagaaaatttgtttgacgttagagagctttctaaatttagaaatacaacaatatatgatcctgaatatcagcagcaataggagtttttagtcatgatttataggcctgaaggagagcttgtaataaatagtatttttaaggtaaaagaagatttgttgcatatttttaagaaaatgaaagaaggggatactcttattattgacctttcaaatgttgaaaaaatagatattacttttatacaaattttgtatgcatctaataaatatgctaagaatagaaatttgtttgtaaaaattgagtatccatccgatgaggttttaagttcattaatatatggcgggtttttagtagatattgaagatgttgatagctttgatttaggacttaatttagttggattttagatttaaggaaagcttatggatagtagtgatgttattgataaatttaagaattcctttaaggaagaatcaatagaaaatatttcagatattgagcaagcgcttcttaatcttgaggtaagctcagatcaagatattgttaattctatttttagaaatttacataccataaagggaagttctggtatgtttggctttaattttacagcatcgcttgtccacgaaatagaaacagttcttgatgttgtaaaaaatggtaaggctgcttttaatcaggcggctattgatgctaccttaatgtctgttgattttattagagagcttattgaaggcgatgaagtaatttctgagatcgactttgataagcgtaaacagtttttggtaaatgaaattagaaaggttcttgatatttctaatgatgttaagggagcttttcaagaagctttagaaaatgatttttcaaagtctgataacagttcggttttggaagagtctgttaaagtaaattcagagaataaatttgatgatgaggctttgcagtctgaatttaagagttacaaaattcttttttctccggctaagggtattttgtttcatgggcacaagcctataaatttattgagcaagttgattaatttgggtagtggttatgttagggccaaagtagataacattcctgatttagagcttatctctcctgataatgtttatgttgattgggagataaggttagatacagaagagagtagagagagcattgaagatatttttacatttttagattctcaatcaaaaattgatattcaagaattggataaatgtttagaggcaaatgaaggtgataatgtagagtctaaaaattttaatttgttgcacttggacagaaacagcaaagacttgactaattcttcatttgaaaaatcggcatttgttgggaaatcctttttcaatggagataaaaatagatctaatattcaagatgatactgctagaagcaaggttaatattgctagtattaaggtggattctaaaaagcttgatcatttggtaaatcttgttggagaacttgttacaatacaatcaaaactttcaaaagaagctgaaaataggaatagtaatattttaaattcaatatcagcagaattttctttgcttattaatgagcttagggattatacaacagggcttagaacagttcctattgagattttgtttgtaaaatttcaaaggatagtaaaagatctatctactagccttggtaagtcaattctttatcatgcttctggaggcgacactgttcttgacaaaagtattattgaaaagctaaatgaacctttagttcatttaattcgcaactcaatagatcatggaattgaatcggctcaagagagagaaagtttaggtaaagatcccaaaggtattattaagctttcagcgtgtcaatctggggattctgttattgttattattgaggatgacggaagagggcttgataagaataaaatacttaaaaaagctatagagcgcaatataatttctgattcagttgccaaaaccttatcagagattgatgtttataatttgatttttgagcctggattttcaactgcaagttctgttactgatatatcaggtcgtggagttggcatggatgttgtcaaaaaacaggttgaatctttaagggggcatgttgtacttgaaagtgaatttggtaaatatactagaatcaagttaatttttccattgactttggctattattgagggttggcttgttagagtaaaagatgagcattttattgttcctctttctaatgttgaatcttgtttagaatctaataagttaatttctcaaatagatggaattgagactaaaagcaatgtaatgaattataggggcagcatgattagttatattaggcttagagagttttttcaggtttctagcgagaagagtttaagtgagcaagttgttgttgtaaatacaaatagtgggaaaatgggcattgtggttgacgaagttttgggtcaacatcaaactgtcataaaggctttgggtaaaatttattctcgagtagaaggggtttctggagctactatacttggtgatggaagtttggctttggttgttgacatagatgcaataactaaacttataaaataaagaaaatagaaaatagaaaatgcagctttttggttttaaaggttaaaaatattaaaatataataatgaagatattagtaattgatattcaaggtcttataaagcaggtttttgttagagctttttctaaagataatgatgttgagatattaaatgctggttttaattctttaaatcttattaatgtatttttacaaaagtttccagatttagttattattgatgagaatacagcaagatctaattttgggaattctttaaacaatgtccttaataatatatctcttccggttgtatttattgctcaaaatgaaatgttaccaaattttggatgtcttgagcaaagcaaggaaaaggttaaattaataataaataagcttaattttaagcttacagttgatttatttcgcagtaagtatttagctttaataaagctggagttgaaaaatctaggcaaaaataaattaatatcttcttttgaagttaaaaggattcaagcacccgatttttctagtaattctaaagtagagctgagggaaaataatttaaatgattcaagtataagaaaaagttatagagtttctgatgttattaattttgctcccaaaaatgatccggatgttattattaaatatcaaggccttatcaataagcacaaaactggtaaaattattgttgtaggctcttcaacgggcggtacagaggctttaagaatttttttaaggtcttttaaaaaagattctcccccaattattattgttcagcatatgcctggaggatttacaaaatcttttgcaaaaaacctaaacaatgagtttaatattgatattaaagaagctgaggatggagacattcttcgtccaggtcttgtaataattgctaatggaagttatcatttgattgtaaaatatagtagcggaaattattttgtaaacctattagatggacctcttgttagtagacataagccttctgtgaatgtactttttaggtctgctgcaatgtatgcaggctctaatgctattggagttatccttacaggtatgggagatgatggtgctgtttgtatgcttgaaatgaaaaaaaatggcgcttatactattgcccaagatcaagaaacctctgttgtttttggtatgccaatggaagctataaaaataggggctgtagacaaaatccttcctttaagcgaaatagcagatcatgttctaaggagatcttaaaatggataatgacaataatggttttgatgccaacgattgtttggcaaccttatttcacaaacttgaagcttttgatgaaagcacaaggcatatttattcaaatttaagcaaatcaattcctaaattaatagaaaaaatttctaaagattctaaggatttatcttttagtattgatttgatttccaatcttgatcttgataatgattcttctttgaataattttatagccaaaattataggagcattagatgattttgttgcttactttaattcttcaacaacttctcttgaatctcaatttagcataatacggagtaaggttaaagatatagaaatacttgaagatgttattgaaagaatgaaaaaaagctctcttgatatggaaataatgtctattaatacgttaacagttgctatgagagcgggtaaggctggtggagccttttcttatattacgagtgaaattaaggttttaacccaatctatgatcaaacaggcagatcaacttacaagcaagggtcgcgaggttaaaattggtctggatagagctaaaaatcaagtatatgaaagcaatacagctgaaaataaaattcttgaagaatttagagataatttaatgaaaaaaatagatgctttttcagatggaataggaagtgtcattgctctttatgatgatattttaaaagttttatctgaatttaagtttaaacttgtaaattctatttcttatcttcagtttcaagacaggctaactcaatctttgcaacatttaaatattatgtattctaatattgatgtttttaaatttagagatataagtgagatccaaaaattaaaaattttatcagtttttacggatacatcaaaagttatagtaaaagatgttcttgaaaagcttgaaaaaaattatactgtttttgagaaatttattgattcctctcttagttctattcaaaccattaacgatttaaggtctgataattctttatacatagatattcctaaaataatagaacaattttctagtattttgtctgatctgcttagaagaattgatgatgttgagaagaataattctaattttttgaatttatattatgaacaggtcaagcttataaaatcattagaattaatgttttcaaatatttcagctatttctgctaggtttcaaaatattaatatagcctcaaagatagaagttgtcaaaagatctgaacttaaagccatggagggcaatatttcagaaatgtctaagattatcaaagaaattgattctaacattaccaagggaatagaatttttggatcaaataatcttttttcttgaaaaagttgttaaggattatgacaatagattttatcttgaaaagaattattttaataaatttaaaaaattattcatagaaattaaaaatgatattcttgacattaagaatatagctattgataatattttgtcttatgaagttttttcaattgaatttatggaaatatttgaagagattaaattagaagtctacaatgttagaaatttaaaaaattctcttttagatatagataactttttaagcaatatggaaagcaaaataaatttcaatcttaatttagaattatctaaggttggaattcaatctgttgagattgaagataaagaatttgttaatagaattgctaatcgatttactttatttgttcataaaaaacacttattatctttgatagaggaagccgaggatgttcattcctttgatgagggtagtgtaattttgttttaatttttatatactttttaggagggttttaggagaaaattagatgaaaaaaagaattttggttattgatgacaatagggcaataaggcaaagcgttgcttatattttagaacaaaacggttttggagtctcagaagcaaaagatggtttagaaggggttttaaggtttaaagaagcagttgggcaaggagataaagattttgaccttgttattacagatatcaacatgcctaatttagacggcattggggttattaagcagataagagaatttggcagctttgttcctatacttgttcttaccactgaatctgagcaatctaaggttgatgagggtcgtaaagcgggcgctactggttggcttgttaaaccttttaatcctgaagctttaatgaagacaatctcaaagatattttaagtttatatttgcaattaatttgtagactttaaagttttattataattaaaatgattttcaatatgttattttagaataaggacaacctattgaaagaggtgctttatccttattttaatagtattaaattttattaatcataaggtttatattaaatttttattagtataaacaagtaatttatgaaagaaaatttttcttaaaagaagcaattattttattagtaatgcttgataattttgaagcttctaaaaaagcaatcaaaataccggtagtcggagtcgaaccgacatgaagttgccctcaccagattttgagtctggcgcgtctaccaattccgccataccggcattaacttttattttactataatagtgccaaaaaaatcattatttttgttaaaaactttttctaagttttcaatattatttccatttactatgtaaagggtaagtccaagttttgaagagagttttgttgctattgggtcaaaaggtaaatttaagcctggattccacttttggcccacaatgttttgtaattgtttccaatttaattttttaaaagctgttgcgtttttaaatttttttgggtctttatcataaacttgatttacgtttgttatatttatgatatcttttttattaaatttttctgcaaattttacggcaatgtaatctgttgagaatcctgatttccatccggaagcaattaatatttttcctttaaaagaaaaattttttaagggattagtgacaattttgtctttacaaaagggattcattactttactcagaaattctgcgtttagtcttgttgatattattccaatctcatcaagttcatgaactttaaaatcaggattgatttttttataagcatcttggtattctcttgcaactcttcctccaccaactattaaaatgatttttcttttttcattttctagtagccatttaaaaacaaagtttttaaagtttttaatgaattctatgttgatttggtttgaatttattactcctcctccaagacttattatttcaagcattcaagctccttatttgggttgatgttttttaaattttttacttttaataatatagcaatttctgctaaacttttcattaaaataagtttgaaacaatacaaacttgttaattatatattacaatttaattgttatgcaaaaaattaaaagaatttgttgtgaagtgttttagcgttgattttgcttagcagtttttattttggaggatattgtgcataagtataaagtttctgttattatttgtttttttaattcggctgaaactcttgatgcaatgataaaggatgctgttaatcaaacattaaaagataaagaaattatattaattgatgatggttcttatgatggtagtttagagatagcagaaaaatatgccaataagtatagctttattaagatttttagtcaaaaaaatatgggtctttctgcttctagagacaagggactttctgaggctcaaggggaatatgttatttattgggatggtgatgattctgtagagagcaccatgcttgaagttctatataacagagcaaaagcagataattctgatattgtttgttctcaattttatatttattttcttgcaataaatgtaaaaagaaaatctctacttccttttcctaattatccattaacaggcaaggaggcgtttaaaaatttgctttttactgtttatgcgacttttggaaggaaaaattttgttgttggaacgttatgggataaattgattagacgggaattaattttaaagaataatattcgtcagcaaaatgtagtatttgaagatatagtttttgttatgcaaatttttttaaaagcttctaaagtttcttttgtaaataattatttttatactaatttccaaagaatgggaagcatgagttcttctattagtgttttacataaatctaaattatctcttaatacaatggaaactttattaaaaagagaaggtatttttaacgaatgtcaaaatttgtataaaaaatttttcttgcaattttattattttatttcttttaagcaaatttatattattagttggaatatctctgataagcttgtttatagggcttataaagaaaagcttatttctgttcttgatgagattaaaggattatctgaatttcaagattgttatgaatatgcaaaaagttttggatttaatgaaattcaaattttacctagaattatgctaaaaatttggaattttagctcaagactttatgtaaatttttctatatttatttataagtttttcataaaaaattgaatttatatttttgatttaattattttttatgttttaacttttaatatattaaggagtgtttatggctattgaggctgttaatgtaaaattttcctataagagaaaagaagtctattcggatttaaatttaaacattgagacccctcaagcctatttgcttcttggcaaaaatggagttggaaaaacaactttacttaaacttgtaagtggacttttggagcccttaaaagggaaaattttgtttaactctttagcascttttccaagaaatcccttgaatttagtgaatttgttttttattcctgaagaattttcacttcccagattgtctttagccgaatacagcaaggctttatctatattttatccaaatttcaatgaggcagattttaaaaaatatttatcggattttgatcttgatatttctcttgacttatcttcagcttcttttggacagaagaaaaaaagtattattgcattctctctagctgcaaatgtttcttgtttattgtttgacgagccaacaaatagtcttgatattgtttcaaaaaatgtttttagaaacatgctttctaatttaaaggatagaatcatttttattacaggccacaatgtaagagatttggcaggggttgtggattatttaatcattgttggggaaaagtcaattcttttttccaattcagtatcttatattaataaaaattataagattaaaattatcagcgagctgaatggaaatgaattatattatgaaaaaaataaggatggatttaaggcgctttattttgagagtagcaatggcgctgaagttgttgatattgagtttttctttttatatgttactgaaaataaaaagaagaggtaataaaagatgtttagcttaaaaagatttttgaatttattttattttgattttatttacaataaaaaattctatactttattaataattcaagttttaggaatgatatttatatcttatttgcttgttagattttattttaatttttcagcaactgattttttaaaattttttgctcctaaaatttttattttaaccttgattatatcgatttttaccatgtgtgattattacaaagtaattcacgatccgttcagaaatattctttatttatctttgcctgtttcaacttttgagcattattttttcaatttaattaaatatttatttgcactacctttaattttaatatttatttattatttaggggttaatatttttttattcctagataatgcattctttttaagaggcgagggtactccattcttagaattaagatatttttatgattttttatttgttcgttattttaattttttatctatttttccaatctttatgttttttagaataacttttaaaacgcatccttttgttaaggttttgatattctttttagggaccattgtgttattgtttttttctacgtcttttctttatttgggttttaaatatgtgccatgttcttcggatttaattttttcttttgacagatttttaggcgacctattttttaaaatagtttatagtttgggattttttttatatttggcttcatattttaagatagtagactttggaagtattagaaaaaaaagcaatttgtttgctattcttgggtttttagtttttttggcaatgtttaattattactatttaaccaaaggttcattatattgttttgttaattataattaaaatagtttaaaagatttaaaacaatggcttagaaatagctttttagctaagcattaataatttttattttaatttaatgtttttgtttgttttaatgcaagtatattttattatgatttgtgaattctttttaagcataagcttaattggattgaaatttaaagttttaattttggggtatacatgaaaaaaaacttaaagattttagtaataacaggaggcgtgatctctggaattggtaaaggagttacatcggcaagtattgcaaggttgtttagatatgattttagagttactccaattaaatgtgatgggtatttaaatactgatcctggtactattaatcctgttgagcacggagaagtttttgtgcttgatgatggaggagaggttgatatggactttggtcattacgagaggtttttaaatcttaatgccaagtctagttggaacattacaatgggcaaaatatacaaaaagatacttgaaaatgagcgaaagggtaaatatttgggaagaacagttcagcttattccccatgttactgatgagatcaaatctacaatttttcagattgcaagttctgagaatagtgatatgttgataattgaaattggtggaaccgtaggagatatggaaaatattttatttattgagacagtaagacaaataagacaggagattgggagtggtaatatttcttttattcatttaacatatgtgccaagtccagctggaattaatgagcaaaaatctaaacctactcaacaaagtgttaaaaccttaaataaagcaggtattttccccgatttaattattgctagaagttcacaagtattgacagaccaaatcagaaaaaaagtggcaatgttttgcaatgttgagagcacttctattattgacaatgttgatgtttctactatttatgaaattcctatatctttttataagcagggtgtacatgagattttaagctctaagttaaatattaaggttgatccaaaaatagaagagctttcaaagcttgtaggagttataaaatctaatttttttgtgcctaaaaaaattattaatattgctatttgtggtaaatatgctgaacttgatgattcttatgcatcaattagagagtctttggttcatgttgcagcccatttggatttgcttattaaaagcactttaattgattctaatgatttaaatgagagctgtttaaaagagtttgacggcattattgttcctggcggctttggaggcaaaggatatgaaggtaaaattatggctattaaatatgctcgtgagaataatattccctttcttggaatttgtcttggtttgcagcttgctgtaatagaatttgctcgtaatgtttgtggaatacttgatgctgatacggaggaaaatttagcaagagacaagcccttaaaaagtcctgttatccatttacttcctgagcaaaagggaattaaagataagggcgctacaatgaggcttggtggatatcctgtgattcttaaaaagaatacaatagcttttaaactttatggccaagatcggataattgaaagatttagacataggtatgaagtcaataatgattatatagatttatttgcaaaaaatgggcttatagtatctggattttcaagtgattttaaaatggcaaaattaatagaaattcctgaaaataaatttttcgtagcttgccagtttcatccagaacttattacaagaatagaaaatccagccaagctttttctaggattaattaaagcttgtatttgagtgtctatttggttttttagtgagtaggcaggtttccaaaattaatgtttgtagtgttctcaaattgcaatattttatagcttaaaaataatttagagaatatggttagtaatattattgttaaaaggtcaaaaaaagcattagctattgttaaattaaacggtcttttttcatagattatatcgtttattactttgggtaagctaaaggcaagccaagttatgctagatattagtattgcagataatatattataatttaagtctattaagcttccaagagagttgttagtaagagttattagattgttgaataaattgataagagcatttattaaaaaactttgtaataaatgatttaaagctaaaacaaagataacaattattttatattgttttttttcagcatttaatgtttcggtactggtaattattttttttaataatatttttcggtatattatttctaataatattttaaataaagtcatgctgactattaatattaaattaatatttgagaacatgaatttgattaacataattttccctttcattttcggcaatgatttaattataattagtatataataaaatattttgatttctttaataaaatttgtattttattatatttatataatagctttaatttttggcaatttttatcaggaggattgaatgaaggaagaagacattagaaaaacaattttaatgaaaaggctagttaaatatttttttgatgagcttaagtatagaatgaagattcgttgtcttagaataagcaataaagaggtgagcactaagtacatacttctcaatctttttaggaaaattgcaaatcttccttttaataagcaatatgaaatagaagagcagtttgctcttgaagttggcgagagagttgtgcttacagatgctgttttgattaaaagaattgatcatgaacgatgtgttattgttgggattgttgaggcaaaaacggatcaagttgatcttgattatgaatttaatagattttttcttcaggacaaaaaaatcaacgttcttttttggcaacccaaaaaagttatcctcaagcaagatgataaattatttacagtagaatcagacgatatttttaattttgacaacgattttaacttgccaaaagttaaagctaaattagaagagtttattgatatttttttatgttttttttcttacagagatgttctttttgagtataatgaagttagtgggcgttactcttgggtaaaaagaaagtaaatttaatttaaaattagttttaaattaaattaaattaaattaaatgaggagaatgatttgtatctttagatggttttatggtttaagatgaaagcttaaatttatttcaaagtaattaatttttaccatttaaatgtaaaaatattttttgtttattgatgtatttgatttgatattaaaagttgaaataatgtgtcaaattaagtactggtgaccctattcaaaaaaaagtttttatgatagaatccctttatgaaaaaattttcgttttttaaaaaaaagaaaaaagctgttgatttaaatcttttaaatgttgttggtaatgacaaaaaagatttgagtacttacgaatataaggctcctgttaaggaaatgctaaagggattttatcataccaaagcttccatttctactttaaaagtaggatttgagtcattacaaaggattttgttttctgaaatagaagattttgatcagatattttctacttttgttgagatgacaaataatgctcgtaatcagataagcgttatttttagtgatcttggtaaaaataataaggaaaaattaaatcaaatatcttctgttattgttggaattcaaggcagcttagaaacaataagtaattttttaggtgctaccaatatgatttctcttaatgcaaagcttgaggctgcaagagctaaagaatatggtaaaggattttctgttgttgcagatgagatcaagcgactttctgatcaggcaaaaggtgttatgaatatgatttctgtaaaggaaattgaggaggtttctaaagatttgatttctcataaccttaaggatttgcagattgatattgataagttctttgccgagattcttgaacagcttaattatcttgagagcatatttaagcgcttttcaagaagtcaagaggaattttcttctttgattgaaagtcttgagagtatagatgctaatatggcttattattcaagaaactgtgattctttgattggctctgatacttttatgctgtctaatgatgaatttttaaaagagctagaatttattatctcagaccaattttcttggattaataatttgagactacttgttgaggggcaaaggacaatattcattcagacagatgcttccaagcatgggtttggattgttttataaaggattgtctcccaagaatgatgctatcaggcagttgtgggaagaagtatacattccttatttaaatattaataagtttgcagctgaaattttgattatatttagggtagagaatcgtagtgatagcggtttaaggcaagccaaagattttttgtctcaagctgagagtttatctgaagaaattgttagaaaacttgagcacattaaaaagatggtaattgaattggataatcaaggaattagtattttttcttgattattttgataagatttgttgcaataatttaaattagagatttaaaaattattatgacttttttaatttttatttatttgattaaggtttgttaaaaatcaagttttattttgataaaataattttaggtatgagttttaggtctaggtttattcatcttcatgttcattcagattattctcttttggatggagctgcaaaaatatcagatattatatcaaaagcaaaaaaatgcaatatgtcgcatattgcattaacagatcatggcaatctttttggagctattaaattttacaaagaagctaaaaaagcaggaattaagccaataattggcattgaagcctatatggcaaaaacttctaagtttttaaaaaaacaggatgatcttggaaaaatgtcttaccatttaattttgcttgccaagaatgagttgggttataaaaacctattaaagttaacaagtatttcttatcttgaagggttttattatcgtccaaggatagataaagatgaccttgaaaaatattcagaaggtttgatttgtacttcagcttgcattggggggctcattccaagacttattttggccaatagatttgaagatgccaagaatgaaattctttggtttaaaaaagtttttggcaatgatttttatcttgagcttcaaaggcatggtattaaagatcaagacattgtaaatgaaaggctggttaagtattctagagaacttggagttcctttaacagcagctaatgattctcattatgttaacagagaagatgcaactgctcaagacatcattgtttgtattggtactggtgctaagaaaagcgatgagaatagattaaaaatggaaaccaatgaattttatattaaatctcaagaggaaatgtgtgaactttttaatgatttgcccgaagctttagaaaatactgtaaggattgcagaaaagtgtgatgactttaaaataacttttccaggtcctattttgcctgattatcaaattcctgttgaatttaatactcttggtgaatatttggaacatctcacacttgaggggttgaaatttagatataaaaatttgacaagcaaaataaaagatagagctttttatgaattgagcgtaataattggaatgggctttgaaggctattttttgattgtttgggattttattaaatttgctcatgataacgatattcctgttggagctgggcgtggttctggtgctggttcaattgtggcttatgctcttaggattactgatattgatcctttaaagtataatttgctttttgagagatttttaaatcctgagcgtatttctatgcctgattttgatattgatttttgttttgaaggcagagatgagattataaaatatgttaccaacaaatatggagaagataaggtagctcaaataattacttttggaaccttaaagcctaaggctgtagttaaggatgtggctagggttttagatattccatttgctgaatcaaatgaacttactaagtttattcctgatggtcctaaagtttctttaaaagaggttttagatgacaattctttgaaagagtgttttactagcaagcctgtttataaagaattaatgaatgccgcattggttcttgagggaatgaatagacatgcttcaactcatgctgcaggaattgtgatttctaaaacccctttaaccgactatgtgcctctttataaggattataagcaaggttctgtttctactcaatacacaatggatttgcttgaagaatgtgggcttgttaagatggattttcttggtttgaaaacattgacgttaataaaaaatgcagaaaatcttattagaagtgtaaatccagattttaaaataaaaaatattccagataatgatgttaagacttttaatatgctaggagaaggaagaagtgcgtctgtttttcagtttgaatctgaaggaatgcagcaaattctaaaagacgcaaagcccgatagcattgaagatttaatagctttaaatgctctttataggccaggtcctatgcaatttattcctcaatttattgctgctaaaaaaggtgttaagagaattaaatatcctcatcccgatttaaaggaagttttaagaccaacttatggggttattgtttatcaagaacaagtaatggaagttgcaaaaataattggaggcttttctcttggcaaggccgatattttaagacgtgctatgggtaaaaagaaagaagacgagatgaatgaaatgaaagtcgacttcttaagaggcgctattgagaaaggatatgacaaagaaattgctagtgaaatttttgaacttttaaagcccttttctgggtatggatttaacaaatcgcatgcagcggcgtattctttaatagcatatcaaaccgcttatcttaaggctaattatcctgaatattttatggctgccaatttgaccaatgaaattaataataatgataagctttcttattacatcgaagagtcaaaagctataggcataaacgttctcaagcccgatataaatcgatcatttagggaatttcgtgtaactgattctgggatttcttatgggcttaatgggattaaaaatcttggaggaattgttgttgatttaataattgatgagagagaaaaaaacggcaaatatagttcttttgaagattttataagacgtgtagatgataaagtaattaataagaaatttttagaatctgcaataaaatctggactttttgatagtttggatcaaaatagaaaaactttatttgaaaatcttgatcatttgattgaagttgtttcagaagataaaaataataaaaaacttggtcaaaacagcttatttggtgctcttgaaagtcaagatccaattcagcaaagttttaattatcaaacttttaaagagtattcttattctgagcttttaggatttgaaaaagagcttttaggattttatgtgtcgggtcatcctcttgatccttataaaaaggcaattgacagtttttccagtttaaatgttttaacagatcttgctgccaaaaaagatagcattgttcaattttctggaattttaaattcagtaaaagttattcaaactaaaagaaataatgcaaaaatggctttcggcgttatagaagattttaaaggcgcaatagatattgtagtttttacagaaagctatgaaagatatagaaattttttacttgaaggcaatgttattggggttgtaggtaggcttacgtttaacagagataaattttcaattgtggttgaaaaagttgtaaatattgagagactttccgaatataaaataaataatattcatattaagtttttaaataataaattaaatgacctacaattacttaattctttaaaggaaagtataagtaattttgaggacaattctggattttcaaatgtttatttttatttaagggaaaatggtaaagatttgaaattaaaaatgaattcaattttaaattttgtgccagatgaagataagcttgataagttgagaaagtgtgtgatagttgaagatgtttgggttgattaggaggtgctgttttggttgttttaatacaaattttaatggtatttttgcagatttataggattttaattttaattaggattcttcttagctggcttgtgtcttcagggattaataccaatgtatttttcagatttatacatgttgtcacagaaccatttttatctttttttagaaaaattcctctttttacatttggtatgtttgatttttctccaattgcagctttaataactttaactatttttgaaagaatgttggcttatgggaattataagctttctacatttattattttattcattgttgaagtttgggagatatttagaagcatttttattgctatagttttctttttattgttgagattattattattgcttttgaatttgttccaaggctcagacttttttaaaacagtcgattcatttttacttcctttgtccactaagataagtggtgtgattactgacaaacacatgtcttatactttacgtttgattgttgggagtgctttaatggtagcatttataattattattgaacaagttgtatttgctattagagctttaggaacatatttgcctttttaggagattaaaatgtttttacatgagtttgaatatgagcttaaaggtataggtggtcttggtgagaaaggggttgaaaggttaaataatctgcaaatttttaatgttaaagatcttattgagttttttcctgtaaaatatgaagatcgtcaaaatatacaaacttttccagatttttctaaggtaaaaagttgtgatatgatgacggtgttcacagttcttgggcataaaaaatttggggatagttctaaaaaaaatttaaagttaacagttaaaagtataaatgaggaacctttcgaaattctgcttttcaatagggcttttttagagaatgtttttaaaatagataaaaaattttatatttattctaaatttacctataacgattatagtggtttatggagttgttctaattttgacagcgaagtttacagcgacaagcctgaaaggtttaaaaaaattcttccggtttattctttgacagagggattaacgtccaagaaaatttcattatatgtaaaagaagctcttgaatatttttttaagtttgggcaaacagacattcctagatttttaatagaaaagtattctttattatcgttaagtgatgctttaaaagagattcactttccaagttcattagaaatgcttgaaaaggcaaaaaagacattaatttacagagaaatttttttgcttcagtttttttcaaggtatagatcttctaagattctttttcgagaaaaaaaagatttatcaaaagatttgcttgaaaaggttgtctcgagcttgccctttgagcttacagaagatcaaaaaatttctattgatgagatattctttgatcttaactcttctaagccaatgaatagattgcttcaaggtgatgttggaagtggtaaaacccttgttgccttgctttcaggacttcctttaattgaagctggatatcaggtagcatttatggcccctacagatcttttggctcgtcaacattatgataatttatctaacatattagcaccttttaacatttcaatgactcttttgactggtagtttaagaaagaaggataaggaacaagctctagaaagcattagaaatggtacttctggtttaatagttggaacacatgctattttttacgaaagtacagaatttaaaagattggcgtatgttatcattgacgaacagcacaaatttggagttgttcaaagagaagagcttaaaaacaaaggagaaggggtggatatgcttttaatgtctgcaacacctattcctagaagttttgcattaacactttttggtgatcttgaagtttcgtttattaaaaccttgcctaagggtcgtttgcctattactacttatttagcaaggcatggaaatgaagataaagtttatgagtttttaagaaaagagctcttaaagggtcatcaggtttattttgtttatccattaatttcatcttcagaaaaatttgaattaaaagatgttaataatatgtgtttgaaattaaaagaagtttttggcgaatatgttgtggacatgcttcattctaagttgccatctgatttgaaagaagaaattatgaaaaatttttattcgaaaaaagtagatattttggtggcgactagtgttattgaggttggaattgattgtccaaatgcaacttgtatggtagtagagcatgctgagcgttttggactttctactttgcatcaaattagaggtcgtgttggtagaagcaatttacaatcttttttctttttgctatataaagagcctttgacaagtgctggcaaatttcgattaaaaactataaaagaaaatttggatggatttaaaatagcagaagaagatttaaggctaagggggcctggtaatttatttggacttgaacaagcaggatatttgaaattaaaaatagctaattttgttgatgatagagaaatcatagtcttagttcgagaagagcttgatttatttttttatgataattctgcttacgataagcttgatattgatttactagacaatcttttttgttcttatttgaatgccggaagaagtatttagtttgcatatttttcaattaggttaataagatttgttttgttctggttccaaaattcaagaagcttatgttgtaaattattaaaatattttttctgaataaagcatggcttaggtcctatgtataagtagtgccaaggctctgctttatatccagtgtccgtttcatatccttttgggtatgaaacggaaaatccgtattttagagagttttcataaagccattttccttcttttgtgtttagtaaattatcatctatatttataaaatctattgctgttcccatatgatgttgagaatggcctggaattgctgattgggtttctgcaacttttctgccataagttttgacattgtaatcaaataaaaatttttgatattcttgcgttctgtaagcagatttgattttaatttcaatcccaaatttttttgcatcttttattagtcgaattaaatcttcgattaatatttttcttactttaatagtctttgctccaagatttttaagatcttcaaaatcatcaatatttaccagatcaggtattttataattttcaggaattggtatttttttatttattagagttaagaggttatttttttctgcatctactaagggttttatttcttttaagaactgaataggatttttttcaataaaatttttgcattccttattcattgcttgggcaatctttagcagtacttctaaatctttttttgaaatgttgttagccaacaaagataaattaataaatagaaataataaagcataaattgatttcatattatttaattataatatattttagtataattaatagttaattctaaatatatgtatattctagattggattaaatttagttaaaagtaataaataaaggagactgtatataaggaatatgatcaaaaagtttaaaaattatgaccagataataaaagagctatttgttatagctattcctacagcttttgaatcgcttttatttcaaatggtaactttttttgataattttatgatctcctatttgggctcttttcatgttacgggagtttctttggcaaatagagtaacttttcttttttttattattgtgtttggacttggtacggctttaagcgcttacgtttcccaagcaattgcaaaaaagaagtttcttcaagtaagacaatcttttgcttatatattattaattggaactacaataggaataattttttttatattttcatttctttttccaagaaacattataaagctatttacagctaatcaggattctttaaattttggatcagagtatttaaaaattatttcattgtcttatgtgctaatggcatattcttttttatctgctatgggatttaagagtgctaaagaagtaaaaatacccttatatgttacttctattgttgttttaataaatattgtttttaattatattcttatttttggctttagcatgggaataaaaggtgccgcatatgctactgtgcttgctagaattgttgagtttgttttctattttttatatagtttgataagcagtaattcatattatcggattaagtttggcgatttttttgctccaaaggtagttactagggctaatttgaaactaattatacctgttttgtctcacgagattttttgggttttaagtataactattttgcatgcattttatgctcgtgttgggagcattgaatacgcttcatttgctgttgcatcaaatctttttgatatttgttttgtattgcttcatggtatgggacttgcaacaggggttgttattggccatttaatgatttacgataagaaacatgttagatcagttggattttttttatcttttttaggatttcttttgggcatttttgtagttattttgcttattggaatatcgagctttgcaccttatatttttagtaaattagattctcccgaacttgttagcgtgtttatttatgtttttgcaagtattgtaatttttaaagcttttacggcacaagttcttgttggggtttttagggctagcggtataccaaatgtttgtttttttattgaatcgggagtaattgttttttatacccttccagttgcttatttattggtgttttatacaaatttaagtttaccaatagttgtttttattgtaaatctggaagagattattaaaaatatatttattataattgaattttttcacgatgattggatacgagagattgagtatgaagaacttgcttgagtatgggatagcgtgatatatttagtgttaataaagattttaataatcttggtggatctagaattcattctgattatactaatttgaaagcaattccttttgctttattgtaggttccggtatttgtctttacaaaaatcttaatttttttatttggagaaatttatgtattcattgggtgtatcgaaaaaggataaaatttataaagatcttttaaaaattgcgattccaactgctattgagttttttttatttaattttatttcccttacagataatgctatggttgcatatcttggtgactatcctgttgcaggagtttctcttgcaaataaattttttgaactgtttgttactattgggttttccatggcaggagcttataatataattgctacaagacaatacaatcagggtgattttaagagctttagaaatacgttttttattagtatattaactattattttattttcttttccgtttattttgatttccatagtgaatcctttttttttacttagattgatttctaatgatgagcgggcggtttactatggagcagcttacttaaatatagctattttttctttcgtatttgcaatcataaaaggacttattgctaatgctcttaaggttgttgaaattgttaaatttcaagtttacatttctgttttttcagtgcttttgaattttgtatttaattatatttttatttttgtttttcatatgggagtagttggagctgctattgcaacaacagttattcgtactttagagcttattgtttatcttgtttgtacagcttttaacaaaaattcaattttgcactttaagttagatgatttgaatattaatattaagccgtttgctcagctaattaaattttttattccaattcttttaaatgagtttgcttggttttttggctatcttgtattgacatcgatttttataggaattgatactcataaatatgctgcttacagcatatctttttctatttattttattatctttaatataattcattccttttgtatttctttaaatattatgatgggctatgaaatgcataatagtaaaaaagaaatcatgaaagttgcaatatatttgagtaaaattggccttaagcttgcttttttaacatcttttgtattgtttatattttcattttttgctccttatattttttatacattaaagtattcgcaccttataggaattattttaagatattcttctgtttctgcctttttcatggctcttgcttttcagtatctttttggattttttcgtgcaggagcatctccaagttttggcgctattatggaaggctctgtgacttttgtttataccattcctattgcttttgttttagcaaattatacaaatttgccttttgaaattattgtttttattccatctcttgaggacgcaatcaaacttgttgtttcacttccttatttttatagtgaaaggtggattaaatccgtttaaacagttggcaggtttgatataattttattgtgcttttagacgaaattaaaaatttaaattttttaatcatgggtttaggccttaatggaggaggagtagctctttctagatttttattaaagcgtggggcaaaattagtaattactgatcttaaaagcgagacggaattagctttaagtattgatgctttaagagattttgaggatcaaattaggtatgttttaggcaaacacgatgtaaacgattttaaaaatgctgacattgttgtaaaaaatcccggtgtgaaacccaataataaatatttaaagtttgcaaaacgaattgagacagatattagcttatttttaatgtttaacaagaaccctatagttgcagtaacaggcactaaaggaaaatctactcttgtatctcttttgtatcaagctttgaaagaaaaatatccgggggtaaagcttggaggcaatattggtgtatctcctttaagtttttttgatcaacttgatggaaaatctcctttgattttagagctctcttcttggcagttgcaatctttagagaattttaatcctattattagtattattacaaatgtttacaacgatcatcaaaactattatttaaattttgatgattatattattgataagtcaaaaatttttgtaaatcaaacttcaggaattgtgattattcaggatcaggcttattgcaaatatttttcaaaatttaaatcaaaagtcagagttattttattttccgaatttaatccttgtgattttgatcaagatattttttattgcaatgaaggcaaagtatattttaatgacagcttgattggaagtttttctaattcacgagctgtttttataattcctaaagttattactttttttgtttcgtattatttaaacatagaccttaatcgcacgggtcagattttaagtaattttaaaggtattgagcacagattagagtttgttaaatcagttcaaaatgtaatgttttataatgatacagcttcaactattcctgagtctactgttttatctgttaaaagtttgaaaacaaaagataaccgtatcaacttaattgttgggggaaccgataaagagcttgattttttaagttttagcaagattgcagatattgtgagaacttggattttaataagaggtagtgcaactgtaaaaattattaagattttagaaaaaagtagcatacaatattttctatttgattctttaagagatgcagtaaattatgctttcaagatttcaagtccgggtgacattgtgttattttctcctgctagtgcttcttttgagctttttaataatgagtttgatagaggtttgcaatttaaaaatttagttaataatcttggttaaatttttttccttattactttgtaatagaagtatctaagtttttcaagatttgcataaatcttataaataaaatttttgtaagtaaaatcataacaaccaattctatgaataatattgcctccaaatcctgttttaaaactaaaaagaccatataaggggtggtttttatttgcaattgggggaattcctaataaatcatattcttttatttctaatttttttaacatttctattgctttaaattgtacagcgtaattgggcattaaatttctatattccttgcttgaagccccataaagatagactgctttttctttgtaaattcccactattatgccagaaataattatgttattgtaaaatgcaattatcaattttatttgagcatttttgtcttgtttgaatatttgaattaggttttgtatatattcttctgagtgaatagtaaatttatctcttttgctagtttctttgtatagcttgtaaaattcacttaaatgtttaaatttatcatctattattatatttagatttttttttgtgctgagctttatgttatatcttgttttttttttcatgttaagcaaaatctcttcaagagaattatttaagtttaatattgttgtgtttgcgggttgtatgtcatcaaaggatttttttagatatttgattttagtttttaatggagagtatttgtcattcagtgttctttggtagtaatacattaaatcgaatcttaaaaagattgtatttttatgtaagtagggttttatttttatgctaaattctttaatacttttactgattttatcaatattaatgttttcaagagttttgtttgagaattctggatgcggaatatatgctaagtaaaaatttttaaatagtcttctttgcattacaacaattttgccaagaacatcgctctcaaatgctatggctttccaataactgttttttgttgtttttattaatgcccacagttcgctttgaagataattttcttccatttcttttgtttttatttttttaatagtcattaatagctcttagcaaactgttccgtttggaatatctttagataaaattttgttcttagaattttctaatattaaatttattccgtttattttaagctctccgttttctgctactatattggcttttaaaaacttatttatgtcaattttaggtgggcaggcaagatctttattctgatcgttttcaagtattattctctctccagcaataggattttgaattgaatcttctacaattataactttaaaatttttatttttgtcctcagcagctattagcattccttcagattttattcccctaaactttgcaggctttaaattgtctactattattatatgttttcctaaaagttcttcttctgtgtaatatccttcaaggccgcttactatttgtttatccttgttagttccgtcatctagttttaatataaataagtttttagcctcgggatttctttctattttatttatttttacaactcttaagagcactttttctctaaacaagttttccggttgctcttttgctataggcaagttttctgcttgttcgttttctttcatgtttttatctcctgaatattttagctttaaattattaatttttttttgctctagtttattgaataatatttctgtgaattcaatttttttaattcccgatttagttccaagaattttggttgaaaattgataactgttgccaaagaattgttgtatctttttgcttgtttcgggaatgaatggcatcattaaaatagataagtctctgattaggtatattaagtttgagattagttcttttgtttcttgtggagagttgttttttcttttccagggttcgttatcttgaaatattttatttccaagggaagaaattttaagtatttctttgagagcagattttagttctgtctttttaaaaagatttagtattttattatattttggtgttatttgtttccaaaacttattttgaatttctattgtttctattacatctccaaagaattttctttgaaatgttaatactctgtttacaaggtttgaaaaattatcaataagttctgtatttactctttccatgagatcttgccacataaattgaaaatcagatttttcaggcctgttataataaatataaaatcgccaaatatcagaggggattcctgtagtaatagcatcgtttccaaaaattcctgttccttctgattttgaaaatttaagattttcgtaatttaagtattcgcttgatgagagttgatttaatattgtccaattttcttcacttccaatttctatgcaagggaatataattgtatgaaacaatatattgtctttcccaataaattgtacaagatttacttgatcattgtttttccaccaagattcccaatttttgataatgtttttggtaattgaaatgtatcctattggagcatcaaaccacacataaaatactttattttcaaaaccttttttaggcacaggaattccccatttcaggtctcttgtaattgccctttctttaaggccatctcttaaaaaagcctttgtcattttaagggcattggtattccaattcttgctagtatctggattttttatccatttttcaagttttgtttttattttgggaagatctaaataaagatgattggttttttttaaaataggcttgtttttacaaattatgcattttggatttattaggtctgttggatttagaagtttagaacagttgtcgcactgatctcctttagccatgctttggcattctgggcattctcctattacatatctatcagccaagaacattgaatctttattgcaataaaactgttcagtttctctctcttttatatagccgtttttttctaattgtaggaaaaaattttgtacaatgtcttgatggttcttgttggttgtgcgaccaaagatgtcaaattcaatattgaaccatttgtaaattgatttatgtatttcataatatttattgcaaagttctaaaggggtagtattttcaattaaggctttggtttctgtagctgttccatattcatctgttccgcagacgtaaagagtttcaattcctgacattttcgaatatcttgcaaaagcatcagctgatagcacttgaactaaattcccaagatgaggtatgttattaacatagggtagagcagctgtaactagattcatttttttcattcagttttccctttttttatgctattaatattgtaatatggataggatattttttttcaatatcttttacaaaaattctttcaaaagcaattcaattttggcttttttgtaaaaaatgatataaatattcttttattataaggagtgtgattttatgaataattgtttaataaagttttttatttttttattagttttttcaaacagttatgttgctttttctaaaaatgtcaatgttttaatagtaactgctatggactctgagtttgatcagataaataagcttatgtctaataaggaagaaatagttcttaaggagtatggtcttaataaaaagattttaaaggggaagttgtctaatcgcaatgttatggttattatttgtggggttggtaaggttaatgctggtgtgtggactagctacattttgtcaaaatacaacataagtcatgtcattaattctggcgttgctggtggcgttgttagtgctaaatacaaagatattaaagtgggagatgtggtggtgtcttcagaggttgcatatcatgatgttgatttgactaaatttggatacaaggtaggacagcttacaggaggattgcctcaaaaatttaatgccaataaaaatttaattaagaatgccatagaggccattaaatcaaaggttggaggttctaatgcatattcaggattaatagtttcaggagatcagtttattgatccaacttatattaacaaaattataggaaactttaaagatgtaatagctgttgagatggaaggtgcagcaatagggcatgtttctcatatgtttaatataccttttatagttattaggtcaatatctgacattgtaaataaagaagggaatgaggttgaatatagtaaattttctaaaatagctgctttcaattcagccaaagttgtacaagaaattttaagaaaactttaagaaatatttaatttttataattgaaaatcatgtatgaaaaaagattttttattttaaaatgtctttttttatgcattatcaattgtgttgtattctttttataaggtgttttgtttaaaagattatgtttttaagaaggcaagaatatttgtaaaagagaataagcttaaggccaatatagtttttcccgaaagtagtgattctagagttttaaaggcagctattgttattttgcaaaaaaatcttgcagattcgattattttgataggcaaaaaagatactgttattaattctttaaaagaattttctaattgcaatgatattttaggaagaatagaagttgttgatcctaattctttcccagatattgaaatgtatttggatgaatattggagtttacaaaagttaaagggagttacgaagcaaagtttaaagactcaagttttagatgaaattacttttgctatgcttatggtaagatttggttatgctaaatcttgtgtttgtggggctgtctcaacttctgctaaagttttgtctaatgctttaagaataatccctaagttggaaggtgttaagattatatcatcttttatgattatggatactttatgcactgckcgtaatgttgatttttgttttggacataatggaatcttattttttgcagattgttctgtagtggtcaatcccaattctttagagcttgcagaaattgcattgcaaagtgctaaatcttttaaagatattttaaatgcaaagcccaaggttgctcttttgagtttttcaacaaaagggtcttctagtgctaaagaaactgaaaaagtaaagaatgctttaaatattgttaggaataaagagagtgatttacttattgatggtgagctgcagcttgattcagccataataaaagatgttgcagagaaaaaatgtagagaatctttagtagcaggttctgctaatgttttaatatttcccaatttagatgcggggaatattggttataaattagtagagagatttgcttttgccaaggcctacggtccctttttacaaggtttttccaagcccattagcgatctttcaaggggctgttctgttgatgaaattgtatttgcaagtgctttaatgataagcatttaaagtgttggaaatttgtataaattcttcaacagaaatgttttcaggtcttttgtctaaatattcttttaaaaaattttctctcagagtagctttattggtaatgaaattaataatagtgttttttaatttctttcttctgtttgaaaatacagttctaaccaatttattgaattctttgaagttttttatgttgttttttttaggaattaattttagtgttgtggacttaaccttaggtgcaggataaaaattgttttctcctatgtctaatattttaattaccttgaagtgtgattgtactaagaccgtaaatgaagaatagtttttgctgtttatttttgcagttattctgtcggccaattctttttgcactgtgaataccatttcttttaaaaagttttcttcaattaatttagatattacttttgatgcaatattgtatggcaaatttgaaaatattttatcaatgttttgattttcgtttttgtatttttttaaaaaatccccttttatcaatttaaagttttttaattttccaaatttttcatttaatatttctgaatattttaagtcaatttcaaatgcggttaaaagattagttttttttaataaaatctcagtcattgcgccaaggcctgggccaatttcccagattttttcattttcttttatatctaagctttctattattttttgccttatgctttcgttgattaaatagttttgtccccataattttcttggagcgatttttctttcttttaatgtttgttttatgctagttatactgttatagttgatattcatagataaaagagatagtatcatattattcttaataatgacagatattttaaaattattttaattttttttagtttcgttattataaataatgtaagttataagaaaaatacttaatattaaaaatataggtatttgatggtgcttgactataaagaatttgctaaaaaatgctgctgtaatttttattgcttgaaatatgtaggcatttataaggtcaaggggaaaaaataaatttaaacttgaaaagtaagttattaagcttaatattgttattgctaagaaaattgatattaatggaatagctattaaatttgacagtattgagattggtgctagatcaaaattattgatataaattactggcgaggtgaatatttgaataaaaaatgttgtaagcattgatgattctagcctgttaagaccgtatctattttttagatgaaccgatgctgatattcctattgttgcaagataggagagctgaaatcctattgaatttagcgtttcggggaatgcaagagcatttattataaaactaatagatgtgcagcttattaaattaattttgccgtaaattagtttgtatattataagagattctgttattagaaatgctcttaccgttgaaggtgcaaatccagttaatattagataatttaataaaattatgcttaatattaagtattttaatttttcattagtgattattaaaaggaaatagtaacttattaaacttattagataaaaatgcagtccagatactaccaaaatgtgggcaatccccgcattttgaaataatgttttttcatattttgttatttctgatttgatattcaaaattattgcttttgaaaaatgggaatagctgggatttagtgtagtgaaaaaattgtttaaggcgtttgtatatttttctctaagcttggcaaaaaagggccttttaataagttttattttttgattttcaattttaatgatatctcctattttgtaaatattttcaatatttttgaagctatatttgtacatatttgatttattgtcaattacttctacaatggtttttgaatcttttttaaaatttttaatgtttgttatttgataaatatttttttttaatgttttaaaatttaatctcgcttgaaaacttaatagcaatattgtgcaaaaaataaaactaagtgctaagtgtttgttgttttttataataaaaaataatgctagcattgtgttaaaataaattaaattgagttttaaataatattgaattaataaattaagtgaaataaggacaaatattaaaatcatttataatattcttatttttatttataaataattatattttgaattttaatttgttttgattaatcaatcaataatcattcgttgacaattaataattatttaattacaatactttatgcaattgttaaaaaataaatatccattcaagcgggctttgcttgatctttttttggtctatgctattgtttatttggcatctccttttgtaaatgttaattcagaattttggaatgttgatgaaaatcatttttatttttggatttcaagatcttttttaattatttttataatttatttttttaaacttaccagttcttatgatgattttagagtagagttttttattcctaaatttaaatttatttttctttgggattctgttttaatttttattaaaacaatattgattgcaatgatagtcatttttttaatagcttttttgcttgaatatttgttgccagaatcggtacttgtctattattttcaaaacaatgctggatttaattggaagattagcagtaaaaaagcattttttttaatgacttttacctctttttttacaggagcttttgaagaacttttttacagggcttttgttattactaagtttacacaaatgggatttcctgttgtagctaccgccattcttagtagtatgttttttgcttatgggcatttatattatggaattttaggatttttggttacatttatattagggatattttttgcttttacttatttaaggtataaaaatgtatattatgtgatttttatacatagtttttataatattattgttagcagcttgttgctttttttgaattaattttaaattgttttgagggggatttatgagtgatactgtgcctaagcgttttaaagatgtggtagctctttatagtgagcttgatatttttatgtataaggagggggaatcaaaaagttttaagaagcaaatatacgctgatttttggaatgagacaaaaagagtggcttctgggcttttgcattgtggcattaaaaggggagaaaaggttgtaattatttctgattctagaagagaatggataataatcgacgttgctactttggggttaggctgcgttgatgttcccaggggaaatgattcttctgaggatgaattagcttatattattaaccattctgaatctacttttatttttgttgaaaacaataagcaacttcacaaggttttatccaaaaagcatgatcttagattggtaagatgtattgttgttattgatgatgataaatcttatgaagaaaaaataggaaatattactgtattttcttataaaaaattactagaacttggaactgagtatttaagagctaatccaaaatcatttgatatggagattgaaaaaggttcttcaaaagacattgcaactataatatatacttctggtacaacaggtatgccaaagggagtaatgttgaggcatgaatcttttatttttcaattagatagactttatgattatcttccaacacttaaacccggcaagataatgatttctattcttcctctttggcattcttttgagcgggcttgtgaatatatagttgctttaaaaggcatagcaattgcatattcaaagcccataggtcctgttttgttaaaagactttttacttttaaatcctcaaatgattgtttctgtacccagaatttgggaaggtataagaataggtattattaaaaaggtatcagaatcttttattaagaagtttgtgtttggagggtttttaaaagttgggattatttatgcaaagcttaaggagagatttttagggctttctcctatttataaaaaaactaattttcttatttcgcttttttcaaaattatttttatttattgggattgttttaatttttcctattaaattattgggcgatattttagtatttaaaaaaataaaaaatgctcttgggcaaaattttgaatttggagtttctggtggtggggcattggttgattatgttgattatttttttaaggccgtaggaattaaagtgcttgaaggttacggtcttactgaaacgggccctattttgagcgttaggcgtcttaaaggccctgtagcaaaaactgtcggccctattttgccagatgttgaatacaaagtagttggaattgatgggagagttttgccttatggagaaaaaggcgagctttgggtcaggtcgccacaaataatgagtggctactttaaggataaggctaagacaagtgaagttttaacagaagatggttggtttaacactggggacttggttagattaacaattaataatgaaatttcaattgttggtagaagcaaggatacaattgttctgaggggcggggaaaatattgagcctgagccccttgagagagttttgggtaaatctttgtttattgaaaatattatgatcgttggtcaggatcaaaaatttttgggggctgttattgtgcctaattttgataatcttgaaaaatgggcaaattctagtggagtttctttttcttccagaagtgatttgttagccaatgaggacgtcaataaactttattctaagcatatttcagacactattaatactaaattaggttttaaaaattttgaaaaaatagtaggctttgttttgcttcaggatccttttacaattggagaagagcttaccaatactcttaagttaaaaagatattatatatccaaaaagtatgaagataaaataaaattaatttttagcaaaagtgacttagatttaaacggatattaggcaagaaaattttgtaaaattttcttgcctacatttttaacatatagggaatattgagcaggtacatgcaattttttattgtttgtaatatggcttttaaaaattcgattcttgcggctgttaaattgatattgtttgtatctattactttaacttcttgatagtacgtgctaaaatgctttgcaagcgagtatgaatagctggtaagtattgaagggtttaaatcttttgccgcattgattatattttcttctaattccgatataattttaataatttcccactctttttcatgttttaaaagttcaaagtcaattttttccattacaggaatagaaagtgctttatatttttcaagaatgctattaattcttgctccaacatattggatatatggtccagaatttcccgtaaaagacaggctttcttttttattaaatacaatatctttatgtatagctgattttagcagataatagtgaattgctcccaatgcaatatttaaagcattttttttagcgctctctttattttcaattttttgtgtcatttcaggtattattaattctattaagtttgagattaggttatccgcatcaattacattgccttctcttgatttcatttttccatcaacaagattaaccattccgtgtgacaaatgaataagtttcttgtttttagaaaggcctaatttttctgctacaaaaaacaagcttttgaagtgctgaatttgttcgcttccaaccacataaatcatttcttcaaaattaaattcttttgttctaactgctatatttcctaaatcttgggtaagatagatagatgttccgtttgatcttatgagtactttttgttttaccttggtgtctgctttttcatctgagtctgaaggtaagtcaatgcatattgcgccatcttctcgtttgtaacaaaatcctttttcaagcccttctaatacgacattttttccaattttaaaaatttcactttcaaggtaaattttatcaaatgaggtgtttgtaatttcgtatgtttcttttattccttcaattgcccatttatttaactttttccaaagttcaattgtgcttacatctttttgctcccagagtaaaagtagatcttgaatttctttttcagcattttcattttcttgtgagtatttgttgtatttaacataaaaatcgccaattaaatgatctccttttttaaaagctttttcaggggtaatgccatttccaaattttttgtatgcaagcattgatttgcagatatgaacccctcggtcatttattaagtttatttttgtaatttttgcacccacagcctttaatattcttgacagactttctcctattacgtcatttctaagatgtcctacatgcagtggtttgtttgtatttggtgatgaaaattctaatattatttttttattgtctagatatttacttgttccataggtatctttttgagtatttaccatttgtattgtattatttatatattcttttctagaaattttgatgtttaagtaaggccccacagctttaatttcatatttagttttaagattttttattatttcttcggagatgatttcaatagggagttttaaggttttaccaatttcaaacattaatatggaaatatctcccagatcactttttggaggtttttgaatatttatattgatattatctagctttatgttatttgataatgctagattagtaactataacattaatttcgtctttaatcttttttttaacacttttattcatttttttcctctttaacacttttattcatttttttctctttaatttttgttagcatattgattaatagtaaaaataaagacgctacaataaaaatgtttgagctatgggccgacatttttatatttataagtccctttattataggtatttcgttgttaaaaagttttaaattgcccgtgtttaatatttctctaataagtgaggttgttgagcttagggtaatgaaaattaaaattggaattttagaatatttaattatcattgatgggttttttagaattttaaagggttcgtttttatgaaatgatattattatggctattaaaatgggtattgaaaatttaaattctttatataaagttggtgttaagtagagcataactaagtaagttaggctggtaaaaattcctattattaatagatatatccctaatatatggcttttttgctttttcaattctatttgattgattattagggcaggaagtataatgcatattgaaatccaaacagatgcgatactagcatctaaaaagttttttgtataagcaaaaataggaaataacattaaatggcttttaagatatttttcagtattataaaatgtctttttttgcatattatttccttttaatctagtttatttggttttaaattgatttatactttcgctaatcccagaaatatggcttgagtttgtagttcctaaaactttaatacgctcaattgcttctactagcgtattaatctcttcttttaaacctttcattgagtttgagaccgtaatattaatttctcctaacagtttgatagtgctaatgatttctttattgcctctaaacatatcatttgaaccaatttttacttcatatgttatttcccgcattgtatttaaagcctttaaaatttcttggctacctattgattgctcttgcattgtatgatttatttcttctattacttgaacaactaaattgattgaatcgaatatttgattgaaagctttatttgttaattcagaggtgtttacggttttggttattgaatccattatttcgttaattgatgaagcaacagattctgattgtgatgttacttgttctgctaggtcttttatttcttctgcaacaattgcaaatccttttccggcttcaccagcatgagatgcttcaattgcagcgttcattgagagtaggttggtttgacttgctatagatgaaattaaagagtttgcttcttgtaatcttgttgagtttttaaaaatctctttaatttgagtaataacttcttcttgtttttttcgcccatcatcagagaacctttttagttcttctgtgctttttgcagctttttgagttatttctgttattgattgtattcctcctatcatttcttctatagccgatgaggactgttcaacgcttgcggcttgagtttcaattgaattgtcaagagatgaaatattttttgataggctttcaattatatttgttgtattagagatgaattctacctgcttttctacttcttcttgtgttttttctatgtattgatttgaattttttattgtattatgtgttttatttatctcgctgaataaatggtctccattttctttaagcagctttactcgttcttgcagtgaattaattacattttttagattttcaataaaatgaccaaaaagatttattgttgagcttattgaatctttgccttttgattcgattttaaatgttaagtcaccgtttttaacttttggaatgacaacattgagtttatctatttttgatattattaaagtttttatggttgatatcattattaatataaaaattattactaagataaatataatggaaagcgaaaccaatctcatatttttaaattcttttgaaaatatgttgttataatctatttttattcctaagtaccaattggatgttgtgatccttgctaaggagattatttcatttgaattgcttgtattgtaatttgcttttccttgagataatgtatttagtatttcagttaatgtttttgggttaaatccaaatatatgctttatgttctttaaaatttcatcttttcctccaaatgcatcaccactactgtttattatgtatacattaaagtattttgatgagttttcggtgcttgcattttgttctagcaatgagttttccaaaagtagtaaaagatattcttttagctcagcgattttttctgaaatgtcagcatataaaataatatatccaacattagatttttttgaatctgttattttatatgctattggaatgtaaaaattgttatttatctttgctagactgttgtgaagaattgaaatttgaaatgcagttaaagctttgcccaatagcaattcttttaaacttatgtactgactggttctttttttttcgcttgatgcgattatgtatccatctttgtttgtatactctattattttaataaaggaggggagtgtaattaaaatcttatcagatactaagtgttcttcatttttattatttaggattgcagaccgatagtcgtacctagtcgttaatatgcttaaagcttttattatttctttagattcatcagaaaagcttttaatcattgcctggttaatgaattttgtaaagtcttgaagttcttttgttatgatttttttatagccttgatctagtagcaaaaaggttgttgcaataattattattgtatatgccagaattataaaattgaatttataaaaaaggttggagttaagtttctttcttttcactaagtctcctcaaaattttgttttttcataaaatttttaaaacattaaatttttagtattctacatgttttattatataattatatatgcatgtagctaaataataaaataattatttgcaaatatttgaaggatttaatctttaagatttagaaagaaaagtctaatttgccaattgttattagtaattatttatatatgatttatgaaggtgaaagttttgttttaagattttaatcatactaatatttatgtttggagagcttttatgacagatgagaatttaattgatgttaatctgaaaaatactaaacgatttctttatctagttttatttggattcctttttttaaattttttattcataggctatgcttatatgaatcataaaaatgaatatttggatcgctttaaatttgattctaagttgtttttaaacagtgtgtctgctgttattaaagccaaatattcggaatcctctaggtttcttgaggagcttataagagatagctataggtttgggatattggtgaattcttcaaaaagctttcttttgtcttcaagtttaaaattaggtgatagtttggatgaaaatagtgatttgtttttaaggtcaagggaatttaactctatagataaaatttttaaaactattcctttagcagaagattcacttgaaggtatattttatattcctatagggaaaaatgttttaatatcaaattcaaatttttcatctttaggcttaaaagatgttagattggatccaatttattctgttcctgtagaaaaaaattctaagtattattcaagatatatgcaaatagatgggaaaatttattctataataagttttccagttagagattctgtttcaacattgggtgtgatagggattttaatatgctttgatgagtcgttagatattattgaaaatcagttgtattcttctcttaaatttggtagtaaaaattataatttttttatgcttgacagaaattacatgcccattttttcaaaccttaataatcttcaggccaaatctttttctacagcttatagtgagaattttttgagtaaagttatagcttatgctaaaaaagattcttctagctctcagtacacttttaattatgaaagagatttttattctttaaactttgtaaaaaccgatgattttttgactcaggggcttattttaaatgtcaattccattcctattatgtttaaatcaaattgggttatatttgttgcatttttattattgtcttttgcaattattttttatttatgcaatacttttgttttttcattaattaatgattttaacagaattgttgactatcaaaaatcaaaaagcgatccttttagtcttgaatctcccttagaggttaagtattcttcatctattatttcttatattagttcaaagctagataatctgtcttctaagagtaatgaatcttttgagaagataaaattttattctgaagatttgaatgaatatttggaacaaatagaaactgctatatcaaatactgagagtatagattctagcattttagtttacgaacaactaagagatactttttctagatttgaaaaatcaattgttgatattttaaaaggctttgaatctattgctgatccgattaatgatcacaataaatatatatcagaaatctcttcaaattttgaagagagtgttagttttttctatagtatagataaaaatttagaaatttttaataaggttgctactataaattctactgatattgaaaatattaaaagtaaggtttttgatttaaatattgtttttgaaaatgtgaataaaaattttgcagatcttttgtctcaaacaaatagtttgcaaagtgtaaataaacttttagtttcaatttcagctcagaccaatatgcttgctatgaatgcagcaattgaagcagcaaaagcaggtgatgcaggtaaaagttttgcagttgttgctgaggagattagaaagcttgctattaattctggaaaatattctaaaaccattaaagatgaacttaaaacggtcgacagcattattgcagtaattaattcagagattgatacaatttataaaaatttcatagacattcaagataatgtggacaacaatttttcaagacacgagaaagtagatcttactcttgctaagcattttaaagaaattggcgagtttaaagaaaggtatttgtctcacgatactaagatcagagatgctaagaatatgtataaagaaatatttaataatcattattttattagtggcaagtttaacaactttagtcaagatttaaaagagtttaaagtttctaagatgaatttagatgcggtaagttctcttcaagaatattcatctttagtaaagtcttctaaggataagatattaaagacaaaggaattgattcaaaagattaatgatgagattaaagatattcttttttagtttttttgattatttgaatcctatgtaaagaacttcttcttctagtaaaagtccagttttcaagtagacctcagcttttactttttcaattaagctttttatgtctttagaagtggcattgttaatattgataataaagtttccatgatatttagatactgtggcgcctccaatgcttaatcctttgagcttgcactcttcaattatttgtccactaggcttgagaaatgctttattgtttttaaaagtgcttccaccacttggaaataaataatgacctctatttattcttgcttgtttatttttattcattttttcttcaataattttcttattgtctttttttaaatttaattcaatttttaatatgaaaaagtttttattttgaaaaggcgatattttatacttaaagtcttcttttttaaattctttgcaaatagtttttcctttatcatctataaatgtaattttttttagtatctcagagatttcattcccgaaacatctagcattcatccacacagcgccccctagtgttccgggtagtccatagataaattctaggccacttaagctgttatcaagtgcaattttacataaactttcaaaatctgcaccacattcgccgacaattttattttcgtgaatttctattttgtttagatatccggtgtatattattggaaaatcaatctctctctcgtcattgactaaaatatttgatcctcccccaagaataaatagtttaattttttcttctattgctgctttaaaaatattttcagcctctttaatatttttaggggtgagaaataatttcgaaatgtttccaattttatatgttgtatagttagctagattttttgtttgaggcttaatattgatttttttaagaaaattatttaggcttttaggcatacgtacttaataataaattagattttttattttttcaattttgagaaatgtatgattttaaagttatataatactagaacaaaggatttttcagaattaacaaattttgaaaatgttaaagtgtatgcttgcgggcctactgtttataattatgctcacatcgggaattttagaacttatatttttggagatttgttaattaaaactttaaggtttttggggtataaagttaattatgcgatgaatattacagatattggacatttaacaggtgatcttgatgatggagaagataaggttgctaagaccgcaagagagaagggccttacagtttatgagattagtgaatttttcacagaggctttttttaacgattgtagaaaattaaacattgtatatcccgacaaagttcttgttgcaagtaaacatattcccataatgatagaggttgttaaaattcttgaagaaaaaaaaattacttatttttctaatggtaatgtgtattttgatacttcttgttttaaaagctatggtgagatggccggcattgatcttattgataaagatatgactttacccagagttgatgttgataaatttaaaaggaataaaaccgattttgttttgtggtttactaattctaagtttaaagatcaggagatgaaatgggattctccttggggatttggttatccaagttggcatttggagtgcgctgcgatgaatttggagtatttcaaagatgctcttgatattcatttgggaggagttgatcatattggagttcaccacataaatgaaatagcaatagcagagtgttttttgaataaaaaatggtgtgatgtctttgttcatggagaatttttgattatggattataataagatgtcaaagtcacgtggaaattttattacagttaaagatttagaagatcaaaatttttcccctcttgattttagatatttatgtttgacatcgcactacaggaaccaattaaaattttcattagataatcttcaagcaagcaagattgctagagaaaatttgataaacaagctaagttatttttatgaatctttagatccagttgatttaaatacacttaataaggatttaaaaaattttggttttagtgtagaaaaagaatattatgactcttttgtagaaaaaatttcttttgatttaaatgttgctcaaggattggctttgctttgggagataattaaatctgacaatctaagctttgtttcaaagcttagattagcttttatttttgatgagattatgtcacttaatctgagagaagaaattttaaaaaatttacaaaaccatgacgtagttattgatgagaatatgaaagctttgattgaagagagaagaatagctaaatgtgaaaaaaattttaagcgtgctgatgaaatcagagatttttttgccaaaaaaggttttgttttggttgatactaaggaaggaactaaggttaaaagaggctaacatttggctatttttttaaaaaacaaatatttttatttaagcctgatttttattatttttttatttttatttgttttttctggatttttattttattcaaagccaattatttatgatatatctccaattcccacttcgcacaaggatattattgttattaaaggaaataatttggggtacagtacaggggagattaatatcaacaataattatttggttaaaagtagcattattagctggaataacacggaaatagtttttaaaattacagatgaagtgaattctggacttatttttgtaaaaggcgaaaggggcactagcaacgaactttttcttgttattagtaggcaagttcctgttaagcttaataggaaaaatataccttttattttttcagaggataaaataattttaaatgcaaattcttcaactttattgcagggtatgaatttgttttcaccttttagtactattacaatttttcttgaaactaaggataagctttatacaattttacctcaaaatattttaaatgtttctgagaatagagtggaatttgtttctcctaaaactttaaattctagtgggaagctttatgttttattggacaatattcaaagcaataaagttccgttttctgttaaaaatgatttttttaagtggactttgagcgattttaaagagtttgtaataattgaagagatttattttagtcaagatgttagtagtaattttgattcaaacccccaagatattaattttaatatcttctatttaagaccaattgagaatgagcgtcaaaaaattacagagcgcaatagtgagcatcttgattttaatattgataatttattttttgaaaacctgaagacaaataaatttatttttaagactagggtaaaaacttataaacttaatttggaatttttagatgcgaaatatttagaaagtattgaagttaatagagatattaacaatcaagagtacaaaaagtatgttcaagacaaaaaaaaagattatttatcttacagctatgttgatttaatgtctttagattctttaattttatctaaaacctctggcagtaattcagtttataagttagctaaagcaattattgatgttttgacttcaaattttaaaattgttgagaataatttaagtttaaaggattctattgaagaaaaaaaaatttcatctggcaatttaatagttcttactaatttattatttttaaagtatgatattccgctgagaaatatagttgggctttactatgattctaattctcttaaattaaaagagcatttttggtttgagttttttttagctggggttggttttgtatattttgatataataaatgcagtattatttaaggatagctctaagtattttttgaatatatctgataactatattcaatatggatgcaaagaggactatgataaaaatgaattttttgatggatatttagattctgggtttttaaagtataaaagcttgacaaacggatcgtattctttaatgcataggtttgttttggaggataatttttaatgagagatgatcaaatatttaatttaattgaaaaggaaaaattaagagaaagagagcatattgaacttattgcttctgaaaattttacatctttagagataaggcaggctgttggtagtattttaactaataagtatgccgaaggatatcctttgaatcgatactacggtggttgttcttttattgatgagattgaaactctggcaatttcgagagcaaaagagctttttggcgcaaagtatgccaatgttcaacctcatagcggatctcaggccaatatggctgccataatggctcttattagcccgggtgacaggattcttggtatgcaattatctcatggagggcatttaactcacggcagcagggtaaatttttctggtatattttttaacacttatttttatggtgtttctagagattctgagctaattgattatgatgaagttcttaaaatagctaaagattgcaggccaaatttaataatagctggagcttcttcttattcaagagaaattgattttaaaaaatttagagaaatagcagatgatgtttctgcttatcttttgtgtgatattgctcatattgcaggccttattgttgccggttttcataattcctcaattgatgtggcgcatcttactacaagtactacgcataaaactttaagagggccaagaggtggaataatactttctggaaaggattttgacaaattagtaaactttaatggaaaagagaagcctttgtttaatgctgtaaattctacagtttttcctggaactcaagggggtcctttagttcatgttattgcgggtaaggctattgcattcaaagaagctcttcaagaaagttttaaagaatacattgctaacgtaataaaaaatactaaagttatggctgaatatttcaaatcggaaggatttcgtattgttagtgggggcacagacaatcatttgtttttggttgatcttagtagttcggatctcaccggtgctgatgctgagaaattacttgagagcgtaaatattactttaaataaaaatgctattccttttgataaaaaaagcccttctttggcttctggtattagaattgggggcgctgctattacttctagaggcctaaatgaaagcgattctttaaatgttgctaaatttattgttagagctttaaaggcaaagtctgatattgaattaaaacaaataaaaaaggaagttgtaagatttattagagattttgacatgccttgattacgctggaggttatgatcaataaatgccaagcccaattagagtgttttttttagtgttgttgtttatttttatttttaatcccgttttaatagcaatgctttttattttatttccttttattttgatattatttagttttttaggtgtttttagaatatactttacaagggattactcatattctagatctagagagtttgaattttataaactttcttttttattaatggctaaattgctatctattttaggaactgtaactggggagcagctaaattatgtcaattttattatcaattctttgaatttgtctgaacgtggtaaatcagaattgtataccatttttcattctgctattactaaaaataataatgctgataaaattttatatacccttaagcttggttattttcagcacaaagatctttttatatggctttttgccactcttaaagaaattaacaggctttctaggtataaaaatttagaagctgaaaaatttatttcttatgttggtgtttttttagaacttgaatctgatggttatgaagcttataaagatattaatattaaaattgtaaatccttatagtgttttggggttaacatatagtgctagcgatgatgaggttaaaaaggcgtataaaagccttgttataaaatatcatcctgataagtttgcaaatgatcctgtaagacaaaaagatgcaaatgataaatttataaaaattcaagatgcttatgaaaaaatttgcaaggaaagaaatataaggtaatcctcaattgtttttaaagataaaaaagaagggccaaagcccttcttttgctgttagcttccgctgtaggctattttgaattgcaagaaagcacttccaatagcagcattatttgtgtttttattagcaagttctataatgttatttgaatcccatccaagagaaattgttgtaaatcttattagtttttcaaggctaagtcctgtttttaaataaatttttgtagcatcgcttgagagtttattagaaggtcctaaaatgtatgctccaatgtaaggtactacatatgcttctgttgaaatggatgctattggaattgcataatcaagatataaggccaagccgagtttcattgcatcttcaaatgtcagattaggggttgtggtctttgtgcttgttgaactttgttcagtttgattgttttcagtggtgcttgaaattgttgtaggatagttttctacagatttttgtcttaaaatatcgtaaagaccgatagatgttatccatcctaatccatttataatcccttttttgttgtcttcatagcttgaaatttcaacatttaagctttgaaatgcattttcagatatggtttttaatcttttttctgtatctttagatctgtaaaggttttgtccatagcttattcccaatgcaactccagattttttgtcttgttctccaaagagtcttgtactgtaggaatcagatcctttaatcgcccaggattctttttcaccggtatctttattccaagcaaaacctatacttgctcctgttgaaaatgcaatgcccaattctgtgtttttgctgaaattaagagcattgccatttggatcaaatatttcagcttttttgttaggatctgagggtgtttcttttttgaaattcgctgcttttgagatgtgtccaaatatagaaaaatcgcttgcaaaaggatctattccaaaatcagttcccatttgcaaaataagataggtatttttatcgtttatttttgttaatccaagcttatatttagctccaaaagatgctaaaattgcagaatttgataaagttgggctcaataaatcgttgccaactacggatttatcttttaaagagtatgttattgatgaattattgaatgtctcgtttccataggctcctgacaagccaaaatttaattcaaaaggtgtttctgcaattacagatttagtatcttcgttttgatcaagtagattttttattggtttccatgttgcttgaattccataaaggattccttgatatgttttattgtatggagtgtctttgtcattctcttgatttctgttacccgtgcctgttccccctattgcaaatgtaaggtcgagttttgggagtttgtatcccagctgaattgttcctatgtttttagaagtacctcttgcaagaattgtccctcttactgccctatcattgcttgggaatccatagtaagtgcttttaaatccagtcataggtgcaaaactaaataaagactctttattaaagtcaaaatctgtcatagtacttattttaataaaaaaatcgtacatattgatttgggctgtaatatctcccacgtcaattttaaattgatcgccttttttgccttccgcttttagtgcaagatcttctaccttaatgtaagctgagaatggatcgtctttgcctaattcgggattagcttcaaatggtttaagcttaatggtaattttgcttttgttttcaaacccaggaacaagctcgtccatatctaatctgaattcacttgtgttttcaaatccaaatgttggcatccatgggtttattttaaatatatctttttcctttaatgcgtctgctgcaaatattgctgcagatgtggttaaaaatatgattaatttatataaaatatggcttttcataattataccttcctgttgtaattataaacttttattagttttagtttttaattaaacgtattaataaatatattatagatatgttattatgtataatatattaacatatatataacatgtatataatattaaaatattaggtaaaaattcaaggccatattattattttgtgatttttgtattattcaaatctataaataagattaattttagtataaattaatcttatttattttaaatgattaatttatactaaataaactagcaatcctgttgctaaaatgtagtataaagcataaattattgtttttgataaaagcttgccttcttgtccaattaatccagcagttgttgttgctattgtgatgttttggggagaaatcattttccctccagttgctcctgttgtatttgctgctgcaagccagtaaggatttgctccaatattttctgccatttgtgtttgtaaaggtccaaaaagaacatttgaaaccgtatcacttcctgttaaaaatgtcccaatagctccaattagtgggctaaataatggtccaaatttacctgttattattgagattccattagcaagatctcttatcattccactatgtgtcattaatcttgatattgcaacaatgcatatgattataaaggaagataatgccatttttttcaaggttaatgtaaatatttttagctgttttaacattggaactccccgtattgaataggatattgttgttgcaagtataatcaagaagcccggagagataatccatttaaagtgtaagggatttgcttctggataaatgctaatagtgctttgaaaagtttttaggtattcatgaattttgttaaaaagaggagatacaagcactataaaagttactattaaaatgtagggtgagcaggcaataattccttttgataaggatattgtgtttttgctttggcgctcagtagtttctttatttccaaaaaaccttgcataaactattgttattgtcatagaaagaatgcttccaaggattgcaggaagttctggacccaaagtttttgatataaatacttgagatattgccattgacattcctgagagtaaggtaagaaggaatactccttttaatcctttaatgccccctcctgtaagaattaccagtacaaaaggtattgttaaggttggaagtattagttggaatgcaatctcagatgaaacaatgttaacatccaagttagttgcttgagctaaagatgttatagggattcccacagatccgtaggcggttgatgaggtgttcattattaaacagattaagcaggcaaaaaatggttcaaatcccattgctattaatattgatacaggaattgcaacagcagttccatatccagcaactccttctaaaaaatttccaaatccccatgcaactagtaatactataattcttctatcagaagatacgtttgataaaatatttttaatagtttctatatctttttgatcttctgacattttgtatgtaaatatggcagcaataattacagttgctattggccatatccccattaaggcgccctcaagcattgcaagacttgtgtttactattcccaagtttttataaaatataactatagcaacggtggctattaatgatatgggtattacatagtaagctggcttttttattatgccaagtccaataattattaggattattggtaccaaagctgttataaaatcataagaattcataaaaatggctcctttttaattgtattgtaattaacaatcaataaataatatataattttaatattacaacatgaatagtatctatgttattgggaaattgttattaactttatttttaatttttttcccgttttgttataatctttttgcagttaatttagctgagattaataaattatcagagtatgcaaagtcaatagttttaatagattttgatactaagcgaatactttattctaagaagcccaatttggtttttcctccagcatctcttacaaagattgttacaatttatacagctttaattgaagctgaaaagcgaaatataaaattaaaaagcatagttcctattagcgattctgcttcatattataatgcaccccccaattcttctttgatgtttttagaaaaaggtcaaattgttaattttgaagagattttaaaaggactttcagtttcttcgggtaatgattcttctattgcaattgctgagtttgtagtaggcaatttaaatagctttgttaatttaatgaatattaatgttttaaatttagggctttttaatatgcattttgttgaaccttctggatatagcagcgagaataagattacagcactagatatggctttttttgtgaaatcttatatagaaaagtttaaatttatgcttaatattcattctttaaagtattttatttatccaaagagtagaaatttaggaactgctttgtcatcaaaatttttaaacttaaaacaaagaaatgctaatttattaatatatgattacccttattcagatggcattaaaacgggatatattaaggaatcaggcttaaatcttgttgctactgctaaaaagggtgagagaagattaatagcagttgtattgggggttgaaaaaggaattaatggatttggagagaaaatgagatcttcgattgcaaaaaatttatttgaatatggatttaataaatattctaaatttcctttaatagtaaaattaaaagaaaaagtctataatggtacagtggatacagttgctcttttttctaaagagcctttttattatattttaactaaagatgaatttgataaaattaatataagttatactgttgataaattggttgctccacttagtggggatatgcctgttgggagggctatgatttttttagaaaatgaaaaaataggggatgttgctttgtttagtggcaaggtaaaaagattagggttttggcaaggtctttataagagttttataaatcttttttcaagagagtattaattttatgttaaatcattttaattttaaattaaaacgcgatgttacaataatagttcctggtgaagcttttgtttcaaacaaaagagtgatttctacaattcttggttcttgtgttgctgttgtgctttgcgacgaatcaaacaatttaattggaatgaatcattatgttctagttaagtcagatcttgacatatctcctgatcaaaggggaagatatgggatttatgctattcctatgttaataaatgcaatgctcgaaaatggagctagcaaaagtaatcttaaggctaagctttttggtggaactaattttatggcaaaaggatcggttaaggtggggcttgaaaattcagagtttgccgttaatacattgaataagtatcgtattccaatcttagctaaagattttgatcaatctaagtcgcgaaaaatttttgcttttcctgaaaactttaaggttattgtggaatatccagacggaacaaaggttttttaattttgtctaatgatgattttttaaaaaattctctcaatcaatttcaatatgaagcagttactactattgaaggcgctcttttaattattgctggtgctggtagtggaaaaacaagggttgttactcacagaatagcgtatttgcttttaaaaggcattgctcagagggaaattttagccttgacttttaccaacaaggctgctaatgaaatgaaagacagaattaaaaaaattttaaaaagtcctcttagtaatcttatggtttcaactttccatgcttttgggctttactttttaaaagaaaattataaattgttaggatatagaaaaaactttagtatttatgatgacaatgatagaatctctcttcttaaagagattttacttgatgagggtctttttaataaaaaagtttctttaaattcgcttagcaatgttatttcacttttaaaaaacggtattctcactcttaatgatttaaaggaagaagatataaatatttacaggctttatgaagagaggttaaggctttataattcttttgattttgatgatttgattttaaagccaaaagaattgttaagtaataattctgatattagaaataaatattctaaaagatataaatatgttttgattgacgagtttcaagatacttctttgattcaatataattttattcgccttttgataaatcatagtaatttgtgttgtgttggggatgatgatcagtcgatatattcttggcgcggggctaattataacaacatgttgcaatttgaaaaagattacaacgttaaagaaataaagcttgaacaaaattatcgttctgcaaaaaatattttagatgttgccaattctgtgattttaaataataaaaatagaaaagaaaagaccttgtggtcctcaaagatgtgtagcaaagttatagatgtttttatatttgaggatgaaattcaagaatctgagtttgttgcaaatagaatcatgcagctttcaaggctagaggattttaagtctaaaaagataggggttcttatgagaaccaatgctctttttaaaaacgttgaaatgatttttagaagacaaggcataaaatataaagtttcagggggaacatcttttttccagagaaaagaaataaaagatattatttcttatttgaatgtaataataaatcctaaaagtgattatgatcttcttagaatcattaatgttccaagaagggggattggcaaggaatatttgaaaaaaattagagatatagcagacaagaagggttgttgcatttatgatgctctttgtgacattactttttcttttacaaatatttctagttatgacaaggctttaaataagcaggtcattgaaagcatagaagattttgtatcttttattgaagagtatcaatataagtttagtataacaaaaaacacgtattccaatataatcaaagaaatgatagaaagtattgaatattggggatttttagttagtgaaaatcccaattcaatcaaagtggctgaatataagtatcaaaatatagaagggtttttaagcataattaaaaattgggaatccaaacaatttggtgagttgagagatttaagtagctttttaaattacatagttcttcaatctaacgaagtaagtgaggaagctgaaaatattaatattaatttaatgacagtacattctgctaaaggtttagaatttgattatgtattttttattgctgttgaagacaatattattcctcatcatagaatcattgaagatagtgaggttgacttagaagaagagaggcgagttttttatgttgcgttaactcgcgcaaaagattctcttgttattactatggctaataagcgtaaaaaagataggcaaatttttgatcagttgccttcaagatttatttcagaaattcctaaagaatttttaaattttaattattatgcagattttgttgaaaacaaagcttaaccaatattattgaatttattgaatgaatttaaagattaatttagtatattatattattaattataaattaaatccaagtatatttatggatttaatttaatcaaaggaaagttattatgagtattgtaattgattcttttaaagagatatcaaaaattccaagatgttcaaaaaatattaaaggaattattaattttattaagcagagagccaaaaaatttggttattcttttaaagaagatcgtgttggtaatattgtagtgcagataaaatcaaataataatattgatatgcatcctattattttacaatctcatgttgatatggtttgcgaaaagaatgaatccagtttgcataattttgaaacagatccaattgaaattgttgaagaggatggatatcttaaagcagtagggaccaccctcggagctgataatgggattggagtagctatgatgttggggattatgagtgaagccaataattttcctcatcccgatttagaacttctatttaccgttgatgaagaaataggtttaataggtgctcttggtcttgattctaatttatgtagtggtaaaagcctcattaatcttgatggagaggaagagggttattttttagttggttgtgcgggatcaagacttgtagaaattgttttttctcctaagtatagccttgtaacgaaaaaaacaaaggtagaaattttgtttaaagggcttaaaggtggccattctggggcagatattcatttagatttggcaaattctttaaaattaatgttttttgctctttttgaaattaaggcaaatcttaattttgagattgaaggcatttttggtggaaatagtagcaatgcaattccaattgaagccaaggctttaatctttatagatgataatgattatgatttattaaataaagagcttaaactgttcgtacttaaagttaaaagtgcatattctcttgaagatgaatttgatattattgttaataaaagagaattttcatcagttaaagttcttgatgaaaatagcaaaaataagcttttaaatatgggaatgggatttttacatggagttcaaaaagtagaaaattatgaaaataagcttataaagacctctttaaatttttcaagtcttttgagaatgcaagacgattatatttttacttttttaataagatctttattggatttagacaaagagtatgtttgcaatcatttacaatcaataagtgatttgtcgggagctaatttgcgtgtaatttatgatgatccttcttggcagcctgataagaatagcaatcttttaaaacatcttcaagaagtgtataaagagatgtatcttgaagatgctaatgtttccacaatacatgcaggtcttgaaacaggcataatatcttctagattgggaggtatagaatctgttacccttgggccttggattgaatggcctcatactactagggaaagagtaaatatttcttcaactattagagtttatgattttttgaaaaaaagcttagaaagatttcaaaaattttagttttgaaaaaaattaatattttattataaattttttaataaaagtcttatggcttttattatttttatcttttattgacttaggaattaaatatttataaaatattataataatcatagtcactagttattggtggttgtagctcagttggtagagcgtcgggttgtggttccgaatgtcgcgggttcaagccccgtcaatcaccctttaatcaattttatttttaactgcattcatagctcaattggatagagcggcggacttcgaatccgaaggttgcaggttcgactcctgctgagtgcgaaattattatttatttagtagattaggcatacttgcaaaagcttttaagtttttgtatactattttgagtatgaagtatgccaggagtggtggaattggcagacacgctagacttaggatctagtgcctttggcgtgtgggttcgactcccaccttctgtaaaaatgcgaaagtaactcaggggtagagtgtcaccttgccaaggtggaagtcgcgggttcaaatcccgtctttcgctttttaataattatcaataaaatttaattgaggcattaacagtgattttgagtaaagatattaagcttcttccaggttcaaaagttgaggttgtcattagagtttcaaaaaacgttattcaggaaaaatacaattcattattgcaagattattcttcccgacttaagattcaaggctttagaattggaaaagttcctattaatgttattgagaataaatattctgagggtttaaaagctaccgttttagaagaagtgattaataattcttttaaagaatttttcaaagaagagtccaaaatacctttaagttatgctactcctactgtaaaggaaaaaaatttaaaattaaatcttgacaaagattttgaatttacttttacatatgagacttatcctgaatttaaaattccaagttttgatgagattgatattaaagtggagatccctgaagtttttattgatgattctgatattgatgatgagattaagaatcttcaaatagaaaattcaattatcattgaagatgaggaaggagttgtcaaggaagatagcattgttaaagtggattttgttgagcttgatgacctttcaaatgagatagtatcaacaaaaagacaaggctttgtttttacggttggaaaatctgagacctattatgattttgacaaagatgtaattggtatgagaataaatgaagagagagttatagaaaaatcttatattgcagattacaaatttgaagaacttgcgggttcttcaagaaaattgaagattaagattaagagtattaaaaaaagagatctccccttaatagatgatgagtttgcacaggatattagtgataaatataatacactagatgatcttaaaaattttataagatctagtcttttaaacattgttgaagaaaaaaaagaaactttaaagctaaataaatttttttctactatttctgaaaaattagaaatagatattccccattcaatgattgaggctgaaattgaaattgcttttaaggatgctaaaaggcaaaataaaaataatatgagccttgaagagtttaaaagtattttttattcttcaggatatattggtggtgataatttaaaagatgagattcttgggaatttgaaatctaaactgataatgcaaaaaatggtagatttagacccaattaaagttactgaaagcgatgttgaagatgaaatggccaggcagtctaagaatttaggtgtaagttatgaggagattaaaaaattttatgaagatcaaaatttgatttcttatttaaaggatgatattaaaagggaaagagctaagaaaaaaattttggaaaatcttaaagaggtaaagggtaaaaaactaaattttagagattttgttaattataaaatttgtgagtaagaaaaatggagtttatgcataatttaatacccactgtaatagagaatacgggaaattatgagagagtatttgatatatattcaagattacttagggagcgtataatatttttgagtggtgaaattaatgatcctaaggcagataccgtgattgcgcaacttttgttcttagaatcagaagattcaagcaaagacatttatctttatttaaattctccaggcggcagtattactgcaggtcttgcgatttatgatactatgcaatatataaagcctgatgtaaggacaatttgcattgggcaagccgcttcaatgggtgcttttttacttgctggtggcgctaaaggtaaaagagaatctctaacttattctagaataatgattcaccagccttggggtggaataagtggtcaggctagtgatattaatatacaagctaatgaaattttaagacttaaaaaattaataatagatattatgtctaatcagataggagttgataaggaaaaactggctcttgatatggaaagagattattttatgacttcaagcgatgctcttaaatatggtcttattgatagtatcttagtaagggagtagttttattttcggtaaaagtttttatggcaagagtaaaaggtcaaaaagtaaaagagtgttctttttgtggacttagtgtcgctgagcttggtggtaatgttgttatatctaatggggtagcgatttgtccggaatgttctaaaatatgtcacaatctttttaaagaaaagttgtgtaagccgctagattctaagtccaacggtttgccaactcccaaacaacttaaagatcatttagacatgtatgttgttgggcaagaagatgctaaaaaagtcttatctgtggctgtttataatcattataaaagaatattgaaaaataataaatatgacaatggtattgagattgaaaaatctaatatacttttggttggtcctacaggcagtggtaaaactttgcttgcaaaaacgttggctgcagagatgaatgtgccatttgcaatagcagatgctacaactttgacagaagcaggatatgttggcgaggatgtagaaaatattttgcttaaattgatacatgctgctcatggggatgttagcttagctgaaaaagggattatctatatagacgagatagataaaattgctaaaaaaaatgaaaacgtctcaataacaagagatgtttctggggaaggggttcaacaggctttgttaaagataattgaaggcacggttgccaatgttcctccaagaggcggtagaaagcatccttatgaggatactattgaaattaatactcaaaatatactctttatatgtggcggtgcttttgttgggcttgaaaacattgttaagaatcgaataaataaaagttctattgggttttcagcaattgaaaaaaagaatataagagaagatacttcattaaagtatttagaaatggaagatttgattaaatttggcttaataccagaatttgttggcagacttcctgtgcattcgtatcttgaaaagttgaataaagaagatttgttgagaatattggttgatcctcaaaattctattgttaagcagtattatcatatgtttaaaatggacaatgttgaattggtatttgaaaaagatgctttagaatcaattgtagatgaagccattttaaaaaatactggagcaagaggtcttagatctattttagagggtcttcttaaagatgttatgttcgaggttccttctattagtaaggctaagaaggttgttgttacaaaagaatctgttttaaatgcagatgttaacccattaattttagtgggaaatgcaattaaaaaaccttgggcaaaagagttatatgaaatcaatcttaaatatgataaaaaatagaaaagaagatcttccaattgttattttaaaagaaaatgttctttttcccaatattacattgtgggtaacctttgataatgaatatgtaattaattccatagcgcaatccatgttagaggaaagattgattttatttgcttattcaaatgagcctaattgtgatgaatctgataggggagtagttaaaaacctatgctctgtgggtacttattctaaacttattcaggttataaagattagtaaagacgtaataaaagttttagttgagtgtcaaagtagggttcttatagacagtgtttctaaaaaaaatgattatttgagagctaaagttacttttgtgcctgattctagtggattaaacagagagctttttacctattctaaatttttaaaagaaacctatgaagcttatagaaattccttatctttaaaatcttatgatgcggataatgaaccaattaattattttgagaatccaagtaagcttgtcgatattatagcttctaattcaaatttggaaaatagcataaaattagaacttttacaagagctaaatgttaaaaccagaatagaaaagttgattgttaatttaagcattgaaattgatcttttagatcttaaaaaagatattaattctaaagttagagctaagttggataaggggcaaagggattattttctttctgaacaagttaaagagatacaaaaaagattaggtaaagatgaaaacgattatattgatagattaaactctaaagatattccagaagatgttaaatctaagattgaaaaagaaatttctagattgtctaaaatgcagatgaattcacctgatgctaatattattagaagttatatagaattaatattagatcttccatggaatgaaaatactgttatgaaaaatcatttaagcgagattgaatttatcttaagaaattctcattatggtatggatgaagcaaaagaaaagataataaattttttggctgtttatcagattaattctaaggtcaaagctcctattttatgtcttgtggggcctcctggtattggcaaaacatctcttgtggagtctattgcaagatcactgtctagagaatttgttaaaatatctcttggtggcttaagagatgaggcagaaattagggggcatagaagaacttatgttggttctcttccgggtgtttttattagcgcaatgaaaagatcaggtaaatccaatcccgttattcttcttgatgaaatagataaaattaatagtagttataagggaaatcccgaatctgcccttttggaagttttagatccggagcaaaattataagtttatagatcattatttagaaattccttatgatctttccaatgttttatttgttacaacagccaattctcttaatggtatgtcaaagccgcttttagatagaatggaaataattaaggttgagggttattcttatattgaaaagttagagattgctaagatttttctgattccaagcataattaaagagagttttttggacaaagtttatataagaatagaagatgatgttatttttaatttgattagaaactatactatggaatctggtgtaagggggctaaagagagttttgactaatttgattaggagacttgtaagggagctgctttatgagtattctaaagatcaaatcatcaaaggcaacttttattcaccaagttctttgatacatgggaataattcgctttttactcatgatcctgatattccaggtatttataaaataatcaatattaataattattataattatgttgatactgaggataacttggatttaattaagattgattcttcggggtttgtttatgggcttgcttggacaaattatggtggtacagttcttcctgttgaggcaactaagtttgagaaaaagggagacattattctaacaggtagtcttggagctattatgaaagagagtgcacagcttgcatattctatagttaagacctattcttctaagcttaattttgatgtgaaggaaagtcctgaaattcatttgcactttccagaaggagcaacaccaaaagatgggccttctgcaggtattaccattgcaacggcaattgcttcgatattgtctgacaagaaagttcctttggatcttgcaatgactggtgaggtgactttaaagggctttgttcttcctgtgggcggcattaaagaaaaagttttagcagcctatagaaacggtataagtaaagttattttgcccaaagataataaaaaagattattctaagcttccagaagaagttaaggacaatatagatgttaagtttgtctccagcttggaagaagtttttgattatttgaatattatttaaaaatttacatatttaaatttatattttaggagtagatctatgaaagatggagttagaaagccttcgggcaatagagcgtcttttagcgctcagcctaatgttaagggcttgagaaagaataatagtttttcttgttttgctaagaataatttgggtaaaagtttttcaaagggtaaaaaaaggggtaaataaaaaaagtggctttaattagccactttttttatttaataacacagaaataaaagatattttatgctctcttagaataatattctacaaccatttgttcattagcaagcgtaggtatctcgtcccttgatggagcatgctttacttttatgtttaaatcatcagcatttacttctatccaagttggcaaatttctaagagacgaagttttttctatatttgatcttattaatttttttaggctgtctttttcttttatttgaatttgatcatttgctcttagtattattgaagggattgtaactcttcttccatttaatataataataccgtgagaaactatttgtcttgcgtgtgctcttgagatggcaaatccagccctatatacaacattgtcaattcttctttcaagtattgagagcaagttgtctccagtaacaccgtgatgtttttttgcttctttaaaagtgttggttagctgtctttcacttacaccataagtaaactttatcttttgtttttctattaattgttttccatattctgtgattttagcttttctggcttttccgtgcattccgggaggatgcggcttttttttgaggattttgtcatattttggctgctcaaaaatgttgataccaaatctccttaccagcttgcctttagctatttgttttctattcatcaattcctcacatattaaaaataaagcatagcagggataggactcgaacctatgaccttcgggttatgagcccgacgagctaccaactgctctaccctgcgtcttacaatttaaaatgttaacacaactttattatgagtgtcaattatttgtttattattaatttaattagactaaaaaatatatatcatttatttctttatattcttgttttatgatttttttaatatcttgtgttttatttataaaatttttaaagtcattttctgaatttaaatttattttgatataaagcacaagtttgttgccttgattatgaaaattgagtgttttaaagtttatatttgaattttttaacgtgtcttttacgcttcttttaagatctatattttgttttgatagcaaattgtttgcgttatttattattacgttaagcccttcttttattatgataaagccaataaatatagacataattttgtcaaagccactccacatgtaggttgcaagcagtaaacttagtgtaatcccaccatgtgagaatatacagtttttatcagcagaagctagtgctaagagaagttgattgttgtatctttttcctatttgaaattttgtcaaatattctattattttcactataaaaaaaatgaagggggttaatggtatccacaagctttttttaagagatttatttgaaaatatttctagtatgttttttttgtcttcttcgttgtggtcgtggttatgatcgtgatcgtgatcgtgtgaatggcaatggtcatgttcatatatagtatcatttttatttttgttctggtgtatgtgtagattaaatccagactctcccccaagagtgataaatttatttaatccggttgtatttagaaatagtgtaaatcctgtcataagtataattattcccatgataaaagctattaagctttccattagtttgtgtccatagggataatgaatggtttcaggcttgcttgtaattttcaaactaaaataagttattgtagataaaacaaagtcggccattacgtggaaagcatcagcaataagtgcaaatgaattaaacagtattccaacagtaagcttagaagatattgatgctacttcggtaaatatagagattattcctattcccattacaaatttatcttcttctatttcagatgctaattcttttttatatttagaatcgttatattcaaatcccaagcttaaaagctcttcttgtatttcagcaatttggcatgaaattgttttaaacttattttttttgccgtagtgaattaaattgctaatcattattctttctatgccttccgatttaaaatcatcatcaatataaaaattaattatttcaatttgatcaacttttgtttttgctttaagatttgcaattaattttgaattagtttcaatataaacaatgtagatatcctctttttttaaaggatccagttttaaataagcaaatttatgaatgttttttaagcttattaccttgaccataattgtaacattctcctagttgttgcataattttactatattagcagtaatgttaaattttatcatttattaaatttaagctcaatcttagtttgttgggggcaaaagtgagggatattttatgcggcaagcagatttttttgtgaaaaaatgtaaaaaaattattttaaataataatgatttgcacagtttaattgataatattaaaaatattttttacgagattttaaaagagtttgacagaaggtcattagaagatatatttgattattattatgaaacccatgatattaataatagtttatacagctttatagaaaaatttgttccaattattaattttttattatttgaagatttggaatataattttaattctgatgagaaaaagcttattttaaatgtatttgatttatctgctcatactcttgaaagcaacaaattaaataagtttgcaagtgctttggtttctctaaagatattaaattaaattaattttttttcaagctcagagtatgttactcttcgtagttcttttttatcaaaaggagatttaagtaaatcttttaatgtataaatttttattggtgttttgttttcactaaatgatttagattctgttattattatttttgtatcttgattaaaaaattctgccattacttgcaggcatatagcgcacggaatacattcaggacttgtattaagtaataaaaaatctatttcttgtacgccaatttttgcaatcatatttaaaatcgcacttctttctgcacaacaagttgctccaaagcttgcattctcaacatttgttccaataaaaaaatcgtttgttttggtcttaatgcaggcacctactttgaattttgaatatggagaatatgaattatttcgtgctttttctgccatataaaatgctttatctatatcttcttgttttagtttttccaaaatttcccacctgttatattttattagccattgtggtttattttattgaaatattgtaatatagtcaatgtaaaataagctaaaaacttgttttgcggaaggtttgcgaactttattatgagagatgttattaattttattaaaaaatataataattttgttattattgggcacaaagatcctgattttgattgtataggttcttctttagctttatcctcttttctctcaagaattggtaaaaattctattttgttaaatgaaggtccttttattagaaaagaaatagttccttttaaggataagtttttatctgaatggcccaatattgagatttcagagtattcagttattattttagattgctcgattttagataggataggtgatgaatttatcttttatgtaaagaatatgcctactttagtaatcgatcatcatatgtctggtgaaaaattagaatgtgagggctatattgatccttttgcaccttctactacttttttaattgaaaaattgataagagagtttggacatgatcttacaaaagaagaagcttggtatattttagtaggattttgtactgatactggtttttttaaatttatttcaagaagtgatccagagccttttgaaatggttgcaagactggtttcaaaaggaataagccttaaagaagtttatagctatatagaaaccaccaaaagcctaaaatcaatagaaactcttaagttaatgcttaacagtcttgaatcttattggaatggaaaggttttgtttacatttttatcttcttctagctctggcaaagatggtggagttagtggggttaatgagcttttttatatgattttaagcaatgttgagaataatgaaattttaggcattttaaaggaaatggaggatggttcgattatagttgggctaagatctaaagattcttttgatgttggaaaattggcagaagattttggaggcggtgggcataaaaatgccagtgggtttagaatcaaacaaggttctctagagattgtaaaaaatcgaatgctagcatacattaaggataatatttatttataatattttttaaagggatggttccttttggatcaaaatctttagtgagtgttaaaaatccagatttaaatgccaagggtgttgttccataaataattactatgttttttatccaatttaattttttaatatggtgaggagtaagagatacaattacgcttattttgtctttgtattctttcaaattttctaaatatttcaagcttccaggtgtggataaattaaatattacttgttcaaatttattaattaattttttaatttcgtcgagtttttggggattaattccgtttaagggataatagttgtaataataagcgtatgtattttgaaatatttttttaccctctacaatcattttgtagtaaggagatattataagtgtttttttggttttagatatttctttttctattcttacttttgtaatactccttaatgtgttttgttcaaaaaatttttcaccttcttttgaatatattttctcatttttgtttaaattaggataaagatcagatttatttttattttcttttaagtacattaattttattcttaatattcttttattagattcaataatattgttttttatttctgaatcttttttcattaaatttaatagcatgttgtaagcattttgttgtatattttcatttaaagatattaaaaaaatgtcacttttggttctaactattctttcaatcgtattataaatgctctcattattgtagtttactgcgttcattaataggtcatcagtaattattatgttattatattttaatttttttctaagtatgtctttaattatttttattgaggatgatgcaggaatattttctccatttgtaagctttggatatgctaaatgacctgtcattattacggggatgttttcttggattaatattttatatggtaaaagttcatttaagcttatttctagtaaattagaatttattattggaatattgatatgagagtcaagagtggtattgccgtgtcctgggaaatgttttgcagtagaaattactcctccttgcttttgtcctttataaaaggccagagaaagaagtgatactattttggggttatccgaatatgttcttggtcctattgcaaaattattttcatggctgtatatatctactatgggcgcaaagtttagatttattccaagttgccttagctcttgtgctatgtaatatcctgtattataagaatcttttggagaaagcgatgctgcaattccaagattgccaattgtttctgatgtatttaattttatgtgctgcgccaatcccccttcttgatctgttgctacaaataaaggaattttaaatttattattttgagatgttttttgagctttatgaatactttctgttaaattttttaaatcttttgcgttccatccaaaaattttaattcccccaagattttttttacttataaaatcaagaacaaaatttgtgattgattgatttgggtagcttatcatgaacatttgccccagtaattcatgatcttgcattttgcttaccatttcatttattaatttttctctttccatcgtatcccaaaaatcaatagaaaagcagttattagctataaaaaggacaatgagataaaaatttcttttcatttaaccatataaataataaatgctaatttagtaatttatatttattagcaagccattttgtattatactttataataatacttttgaataataacattgacaaagcattattgaatttatacacttaataaaagtttaagctgatgtagctcagttggttagagcactcggctcatatccgagttgtcgtgggttcaagtccctccatcagcattagaggttgtaaatggtagtaggaattattcttgcaaatggctttgaagatattgaggccataatcccgattgatattttaagacggggtaatgttaatattcaaattatcagcacaaatgatagcaatgttgtgataagttcaaaaggcgtttcttttttagcagatgatataatatcaaactgtaaggaaaattgttttgatctaataattctcccgggaggtatgcctggagctactaatctttttaattcaaaagaattggatttgattttaaaagatatgaattccaaaggtaagtttattgcagctatttgtgcttctccggtagtagtgcttgctgctaaaggtcttctaggattcaataagtttacatgttatccaggtttggagaaaaatgtgcttgatggtgagtttgtagatgaaaatgttgttagaagcaataattttattacttctaaaggagttggaacttcatttgaatttgcttttactcttcttgaaatggtaaaaggaaaacaaataatggaagatgttaaaaaagcaactttgctttgcaagagttaaatataaatctattttaaatgattataataaataaaccagattttagtttttaaaattgtaaattataaattttttggaattaaattataaatgtcttcaagaatggttgattcttcgtttgttggtattgccagtatttttagtttgctattaatggttgatatttcagattctaaatacttactttgggccatttcatttttttcaaggtccagttctattccaattttttcaaacccctttagtgcaagagctcttattccataatcagtaacaccaattccgcctgtaaaaactattgcatcgacattaaaatcaagagcggcaatgtaagatccaatatatttttttattctatatgtcattatttctactgcaagttttgattgatattctccttcttcaattttgttccaaatatcccgcatgtcatttgatttttcagaaattcccagtatgccactttctttatttaatatttcttcaatttgtttggtggttttgtttaatatagtgctcatcaaattaataattgatgggtctatatcaccgcttcttgttcccattgcaaggccttcaagcggagtaattcccatgcttgtgtcataagattttccatttttaacagcattaatacttgctccgttaccaagatgcaatattattaaatttagactatctatttttttatttaaaatttctgaggatctttttgttatgtacgaataagaaaggccatgaaagccatattttctaatattgtggtttttataccaagaatatggaattgcataaagaaaggcatgttcttttatagtttgatgccaggatgtatcgaagcataaaacttgctttgcgtgtggtaaaattttaagcaccgcttctattgcggtgattgcatttgggttatgaagtggagcaagttcagaaatttgttttaatttatttaaaatactattattaagaattactgaatttttaaggcttgatcctccatgtacaaccctgtgtcctattattttaatttcgctaagagttttaaggatttttaaatcgctgtttgtgagtattttaaacattttttctattgctttttggtgattttcaattcctttttcaaatctttctgttgttgatccgtcagtatttacaatttttatgattgatttttgtgattttattttttcaacaattccagatattattttttttgaattttcatattgataaatagcaaattttaatgaagaacttcctgtgtttatgattaatattttcattttttttccttttgtatttgacaagttatgtgcttgtttttagtaagttaatatttttatatatgtaatttattttttcagatttttcaatatttttaaagcttaaaaatattgatttttgatatgagggatttaatattaataaattaggatgtttttgaagtatttctattattttttccataggaatgctttctatatttttgtattctatttccaaagccctgtttttttcttttaattttgttatgtttaaatcttttgctagaattttaagttcagctaacattaatagactgtttatttcttcgggtattgggccaaagtcgttgtggagctctgatcttatttttttactttcctcttcagtttgaattttaaagatttttttgtagattagtattttatcctgctcattttttgcataattttcaggaataaatccactatagttaattttaatatcaacctcttcttcatctgatgagatttttcccattttcttttcaattgctttatttagcattgttagatagtaatctagtccaatcgactcaatctccccatgttgttctctaccaagtaaattgccaacacctcttatttccatatctttcattgctattttaaatcctgctcctagctctgaaaattctgttattgctcttaatctttcaatagagcgttcatttagcttttcgctgtcttggtacaaaaaataagcataagctttctgagatcctcttccaactcttccttttagttgatatagctgtgcaagtccaaacttgtttgcattatttattattattgtatttgcatttggaatatctattccattttcaattattgttgttgccaataaaatttgatacgcttttttaataaaattgtgcattatattttcaatctcttctcctgttagttttccatgaattattgcaattcttgcataaggggttaatctttcaattagtgtttttaaataatacagttcttcaatattatgatttactaaaaaaacttgaccatctcgagacagttcactctcaattgcatgttttattaaaagttcgctaaatgattctaaataagcttctatttttactctgttttgaggcggaatttttaaaacggaaatatctctaagcttaattagtgacatgtgaagagacctgggaattggtgttgcagaaagagcaaggcaatcaaccgaaattcttatttctttaagtttttctttttcttttacaccaaatctttgttcttcatcaattattattaaccctaaatttttgcaggtgaatttttttgaaagaattttgtgcgttcctatgattatatcaatttttccacttttaagttcttttaagatccggctttctgcgttattttttataaatctgcttaatacttcgattttgattggaaaatttttaaatctttttttaaatgtattgaaatgctgttctgctaagatagttgttggtgagagtacaataacctgtttgtttcccattacggctttaaaagcagctctcatggcaacttcagtttttccaaatccaacatctccacaaagaaggcgatccattactttaaagctcatcatatcttcttttatttcttttattgctcttatttgatctggagtttcatcgtatggaaattcagattcaaacaacaattgtaattcattatcttctgggtatttaatacccttaatgctttctctttttgaataaagttctattaatttgtctgcaatctcctcgattcttttttttgcgtttgctttgttttttatccatgttttagaacttattttatctaatttgatatttttaggatcacttccaatgtatttttggattaaatttgtttgttcaattggaataaatagtttttctccttcagcgtattcaatttcaatataatccttttcaagagagcttgtttttattctctttatttgcctaaatataccaattccatggtttatgtgaactacgtgactatttttctcaatctcaacaaaagagtcaatagcttttgtttttgaagattcaaaggctttgtttattttttgccccgtattgaaaatgtttgattcaagaataatggcaattttttctttttctattattaaagagctagatatttttaaaacctcaattgatacttttggcaattctttgaaaatatatttaagtttttctttttgtgattcagattctgctgcaataatgattttaaatccatttttcagccaattttcaaattcttcttttgtaagtgctatatttgaaaaaaagtttctctcactttcgattttaaactctatagtttctttggatttaaggcttttaatttttgaaaataaaacatcgctttttagattgaaggttttataatttaagagaattctttttggatcaattatatttttaccggcttcttctgcttctttgtaaagcttttcatattcttggtgtattttttcaatttctttttcgaaattgttaatttcaaagtttacaataggtgtgtgtttttcaatctcatcacctaagtaagtatttgctactagtggataaaacatttcttctgtttttgtttcttttttaaaatccaactcttcaagaatctttttatattcaacagatttaatttttgtttttaaggtgttaatagttttatcgtcccaaataatttctttttttggaagaatttggaattctaaaatttcattatcgtgttttaattgggttaagggattaaatttttttatttcttctattttgtcaaagtttagtgcaattcttattggattttgttctccaaaagggtatatatctataatttctccttttactgtaaattctcctggaattgttactcttaatgttttttcatatcccaatgttataagagttttttcaatgtctgctgtattaatattggtatttttttcaattttatatatattctttagtaatgtatttttatcgggtattttgctaagcaatgatttcaagactgtaatatatattccaggattttttttataaaaattgaataagaatttgattctttcgttaaagatcgtactttttgagccaatgcccttgtatacaagggggctaaaatagttaagctcaaagatttgatttgtaattacttgtaaatcgtttttgattttatctaatgtgtgctcgtctttaactattaatattattttcccggttttgctatattctttgatttttttaattaaaaaagccttgaaaaatccttcatatcctgttaatgaaaaaaatatattttgttctaaaaattctttcattttttttaaattagaattattctttaatattgttgttagttcttcatctatattcattttttacctttttgtttaattaatttagtataataatatactataggtattattactttctttatatataatgtgtttaggttttgaggggagcttatgaatattagaaaattgcttttttgtatcttttttatgaatatttcttttcttttgtttgcgggagattacaagggccttgattttaaaatcaagttttttaatcaatctatttatcgtgtcaatagtaatgtttttattgaagtttctcttagtaatgcgtctgagagtgttttaactttagaaataggcgatattaattcttttggctttgattttgatgttactgataccaccaatattaaagttaaaagacctattgaatatgttaaaaagagatctaaaaatgttgcaattcctgttagaaatatgagcttgagacctaatgaaaaattttctgtagttattaacttaaatcaatttgttaagtttagtaaagatggagtttattttgttaagggtatttttttcccagacatttcagatccatctaagaaaaaagaatccaatattattacgctttttttgaatgatggttttgatgaaaatccaggtagcatagaccttgttaatttgtctgaaaataatgatattcaagatatcttgaaaaagaaaaaattatctcccgatgaaattgttaaatatttgttaaaggcattgcagcttgggaaaaaagaaaagttctttttatatcttgatattgaaggtttgttattaaatgacaagggcaaggcatacctttataagcaaaagttatcacctattcccaataaaaatgtagttgaagagtataaagaatatttgtggaattctaataattcggatatttcaaaagcaccaaataaattttctattattgaaactacttattctgatacttctggcaaggtgattgctgatttatattttgacgatgggcaattttatatttccaaaagatatactttcttctttaaaaaatatgattattattggataatttatgattacattgttcaaaatactggcattaaggaaaagtaaaactttttgtattttgcaaattatagatcttattatattattttattttttaataataggtcctgtaaatcttaatgccgattttgagtataaggttgtcaagggagatactcttttttcaattgcaattaaatataaagtcaaagtaagcgatcttaaaaggattaataaacttaatgttgacaatattaaggcgggtcaaatattaattattccaagtgattctaatttaggtcaaaacattacccacaaagtcaatcattcttttagtttgctagaatctagtaaagggggagttttttacaccgcaaaagaaggcgacaccattgagagcatctcaaagcttgttggactaagtcaagaagagataattgcttggaatgatttgcgttctaaagatcttaaggttggaatgaagcttgtattaaccgagcctgattttttaaagccttatatggttaggaaaggtgattcactttcaaaactttctcaggattttgatattagttctaaggatattttaaaatttaattttcttaatgatgataaattaaagattggccagcaactttttttaaagaaagccactaagaatgttaattttcattatgttaaaagaggggaaactcttggcagaatagcttatatttatggcgttactgctaaggatcttgtagcccttaatggcaatcgggctattaatcttaaagcaggttcattgttaaatgttttaaagattgtaaataatgatttagaaaaacctgttgagagagatttaaaaattgagaaaaaaatagataataagtttatctatcattcagttgctgtaggggagactttgtatagcattgccagacattacggtgttttaatcgaggatcttaaaaattggaataatttaagcagcaataatattatgcacgatcaaaaattgaaaatttttgataaaaaactttcaattgattcttctataattaaaactaaaaacgatttatatattaaaaaaaaggttgattctggctctaattcttctaataaagtgcaaacaatagttaatcttccctcaagtaaaaataaaaaactaaatttaaatacttttggaattactgccaatcaagatctttttgatattagctctttggttattttagactccaaaataccaatatttgaggttgttggtgatttctattattggtatagaccaagaaagataagtcagccaagtgagttttattcagaagattggcattctcctttgaattcttataaaaaggcaacccagcttttcaaaagttttgaaaagttggtaaattctaggtttaataaaggatcaagacttaaggataaattaataattcttgatccaggtcacggtggtcttgatcctggagctattgttaaatctagagatggtcttggaaatgaagtttttgttgttgaagatgaatatgtatatgatattgccttaaggctttatgtataccttaaagaagagggggccaatgttgaatttactattttagcccccgaccatttaattagaaatagtgtttttgctaacaatacttttgttaatgttaaaaacgaggtttacaatgattatgatctaaataaaaatgatactgttgattcttggataagcggcactccatcaggccttaaaaaaagattagtcgttgttaaaaacattgttaataaatataaacatattaaagataaggatatagccttttttagtttgcatgcggataatagtgttggagcgcctaagagtatggggttttattatcaaaaagatgacgataaaaaatatgatattcattcaaagtctgcagcagaaaaaattacagaaggaatgaaaagaagtttttatattaagggtcaaaatcttcatgttttaagaaataatatagtaatgactaagcttttagtagaagttagaaatttggcatttccagaggaagcttgggctattagatcttctaagcttagagatcaagattctaaaattcttgctaatgggattttaaaaatattggaaaataattgacaaaaatttttaaatttaagataatatttttagtgttcaatttcccctatagctcagtggtagagcgggtggctgttaaccactaggtcggaggttcaagtccttctgggggagttagttaaagccaattggttttttaggtctgttttttttattttaaagtaattcagcctttctaagagttttttactatttccatcccccaaacaaaagtgtttttgtattttttgtctattttcttttgagttttctcctattatgccaagttctaacaaatcgcttaattttaataaatctttttgattatctttagataaagttccaacccccttaagtatttttattatttctgttttatttactgattcaacctcagtgtctttagtattaagatatgcatgtttgattttattattttctcccagatatttgactattttttgtctaataatatttccagatttatcgctgtctgttaagattattattcctttgtattttaaggctttttttaacaacttaatagtttcaatttttaaagcaaatccttttgtttctattactgtgcagtcaaaagattctttgattcttttaagatcatcttttccctcaactacaattatttcttttattttttccaattttaaattcctttttcaaagaaagcccttagcaatttaattgcttctatgtggtcagctattgatactgtttcgcgcagggaatgcattgcccacattggtgttccaatgtcaatagtttctattcctgttcttgcatttgagattggaccaattgttgtgcctgaaggaacatttgctttcattattatttcttgaatcttaatattgtttttaatagccaaattttttaattttgcaaatcctgttgaagttgttgcatatctgaaattagcactattttttacaactacgcccttacctagatttgcttgatagtttggatcatgtttagatgtataacccggatgaatgccgtgaacgctgtcaattgagatattaaatgatttgtttgtttttattaaatgctcttctctggttaaatcaagagcaatatcgattctttctaaaacttctgataaaaaatttgaatcagcgcctcttgatgttaaagaacctacttcttcgttatcaaaaaatacagctattttatttttatcattgcttgtatgaacataagaattcatgattgcatggcatcccgatttgttgtcaagatttttagaagccaaaaattctccttcagttcctattattttagaaggttgtgattctgtgaatattaaatcacaagatagaaaattttcacactctattccaagttgttctaagatattatcttttattgcttttttagtgctactgattactgttaaattgtcatgagcattgtatttaaatccttcgttaatttgtcggtttaaatggattgcaaggtttggaataattcctatgttttcaatgttgattaattttgattcaatattctcattttttttgaaatatacaattcctgctaagcttaagtctctgtcaatccaagtagaaattattggactaccataaacttcaatatggttataaaacacaccacttactttttctgttgcgtctatttttaattttaatcccggactgtctgtatgtgctgctgctattagaaacggttcatatttttttttgacatcaatattaaaggcaataaggctagttccttctttttttatgtaatatgatcctgttttaattttccatttttcattaagttttaattgttgtgcattaaaataatttattaatttctcttcaatatagtttactaagtgataaggggtagggctattgtctagcagactttgaaaaaattttggttctagtgttttakcaktcaccataggtgttctcctttagttttattgctttatagctatatattctattataatagtttttaactgttagttaggagtttgttatgagaaagtgttttgttagcttgagtttattgttgattttttttgcttgtagctctaatgttgaaattgagttaaatgatgatattagtggtattgtttcaatatttgttaatgttaatagagaatttgaaaaaattagaaaagaactcttaacaactttggtgggagaagaaattgcaaatatgcctctttttcctgtagatgaaataaaaaaatactttaaaaatggagaggaaaagcttgggcttaagcttttgagtattaaaacccaaggagattctattaatttagttgttaagtttgataatttaattaaaattttaggcgattatatgaaaaaacccgatatatctgtgtttaagatagaaaaaaaagatggtaaaaatattattgaacttaatattaatttggaaaacgctactaagaatattaatgaaaataaagaatatattagtgatgcacttgctgctcttttgccatcggatgagatcccaatgtctgccaaagaatataaagatgttttggtttattttttatcggattttacttccaaagcaagtgaacttattgacaattccaaacttaatcttgtagttaagacttctagaaatgttcaagaacaatttggattcaaacaaattaactcaaacacactgcggtttgagatggatatggttaaaggattaagtcttgaaacaccaataaaacttagattagtttattgactgggttcaagaatataaacttaatcgtttatattcttgtattcttttttaaggattcctattaaaacagctgttataatagatcctaccaggatagatgttatccacattaatgggtttactactattggtagaataaatattccgccgtgtggtgctataacctctaccttgaaaagtgcagaaataaatcctcctacagatgagcctagtatacatgcgggtattacccttaaaggatctgctgctgcaaatggaattactccttctgtaataaagcatgctcccaaaaaataacaaacttttccagattctctttcttcttttgagaatctatttttaaataaacttgtagcaagagcaattcctatgggaggtatcattcctcctgccattatgcttgcgtgaggaatataatttttggcagttatcattgcaattccaaatgcatatgcagctttatttacaggccctcccatatctattgccatcattcctccaagcaaagctccaagtattgccatattagtaccgctaagttgatttagcatatttgttattgattcattaataacagatattggactaagcattccatatatcaaaattcctgaaattataactgataaaaaaggataagttaataccggatttattcctcttaaattgctaggaattattttgtcagatattttttttacagttagtgtaacgtagcctgaaataaatcctgctaagatgcctcccaaaaatcctgcatttccattgttcatcattaatcctgtaatcattccaggtgcaagtcctggtctttctgctatgctaaatgaaatatagccagcaagtattgggatcattaaagcaaatgcgcttccaccgccgatttgcattagaatatctgctattttattgtagcttggatcgtttatgtcaaatgctttgattccaaacatgaatgatattgctattattattcctcctgagactacaaatggaagcataaatgagaccccattcattagatgtttataaatccccgtttttttgttttgtttttggagggtttcggtggttttgtttgtgttgctttttttgtaaattggtgcttcgtttttaagaattgtttggataagctcttttgctttgtgtatgccgtcttttactcccacttcgattaaaggttttccgctaaatctttctttatcgatagttttgccagatgcaataatgactccttttgctttttttatttcttcttctgttattggattttcggttccactagatccatttgtttctacttttatatttatgtttaattctaaagctgcttttttaaggctttctgctgccatataggtgtgagctattcccacaggacatgctgttacggcaagaatgaaatctttttttgtatttaaattgttagattcatttatattgtcattattcaatattatttctaaaaatctatcttcattatttgtgctcataagttcatgtcttaataggttgttgctaaaagtattacttaggtatgatatagcttttatgtgtgcattgcttggagtttcttcgggtagggccatcatgaaaaacagttttgaaagcttttgatcagaagagttgaagtcaaaaccattgccaacaactcttaaaatagcaattccgtgttttttaatgaaattgccttttgcatgaggcatagctatatgctcttcaatgcctgttccgttagtttcttctctttttttaatttcttttataaatgcttccatgtcatttaagtatccattttcattgaacatgctagccatttttctaattacatcttctttactagttgcattgtaatttaaaacaatcaagttttttgaaaataaattttgcataataatcacctttatatattatatagtgtatatacatttattaaattttactatttatttaattgattttataaatcaaaggagattatcttgatatatactctaacactcaatccttctgtggattataaaatagttttaaaagaatttcaggaagaaagtcttaattatgctttaaataacaatttttttgctggcggtaagggaataaatgtaagcaccgttcttaaaaatttaggaaaacctagtacggctttgggatttttgggaggttttacgggtgattatataagattttctcttgattctaggggcataaaaaacgattttattaaaataaaatatgatacaagattaaatattaaaatgatagcaaatggcagagaaacagaaattaatgccaattctccagatatttctgagaatgaatttgaacttttgaaaaataaacttaaaaatttagcaaataatagtacattagtgatgtcaggaagtgttcccgcagctcttggtgaggatgcatacaatgaaatagctaatagcatttctaatgatgttaagcttatcattgataccagtggcaaacctttgcgaaaaattcttagattaaatccctttttaataaagcctaatatttatgaacttgaagatctttttaatgctaaatttgattctacaaaagaattgattaaaatcggaaaaaatcttgtagaaagtggggttcaaaacattataatttccatgggaagtgacggagctatttttattggcggcaaaaatgttgcttttagggcctttgttcctaagattaattttgttagcaccattggagcaggagactctgtgattgccgggtttgtatatgcttttgataatggaagtactttagaggattcatttaaatttggtgttgcagctggtacagctacggcattaaaaggcaatctttgtgaatttcaagatgttaaaaagatgctttgtcagattagggttgaggatatttacacttcttaatattttaaatagagctgaaggattgattttgaaactttactgtagcttttaaaagctacagtatttagtttgcttaaatttttaattttgatttatataatttcttttttgctagagctaatcctgtaattactagcaatgcaagtatagccatgcttgtaaaaaagcctgttgtatttgattgagagacttttgcagcgatttctgtactttgttcatcgcaaatacagttaacatatccgcatattgggcagatctcttctactccaaattggcttaagttcccatttggaattacattttcttttgctattgtgttggtttgtgcgaaaacagatgttgaaattaatagtaaagcagttaaaaatagatatttttgtagattcattttacattctccttatagattttttttttaattatttaaattataacctttaaattaaagatttgtaatttttttattaaaaatttgctagagcatcaatagattctctaagaaaagctgctgacacaataaaatgtaaaattcatcatcgggagcgacgggtctcgaacccgcgacctcctgcgtgacaggcaggcgttctaaccacctgaactacgcccccaaagccattcttttaaaaagattatagtagtttttaatttatttgtcaatttctttaaatgagtttacgtgttctagtatttttgaatctcttttgctagattttttgcttaacttaataatagtctctttgttagaaattatttctaagctatccttggctcttgttattgcagtatacataagttcttttgtcaaaaaagggttattttctaatattacttttatatgtttgtattcagatccttggcttttatgtattgttgtggcaaagctgaattcataatttgttagtaaatctaaatttatttttttatatttttcatcttttctttggaataaagcataaaatttagaattttcattaaaaataacaccccgttctccattaaataatttatttttatagtcagttttagttatcattattatttggccaataaagcttccataggtctttttcaggtaagtttttattatttcatttagtgttttagttccaaatttgccaaaattttttgaacttaaaattatattttcaagtaaagtttcaagtattgtttcaatttttgattcttttagtaatttaagattaaaagtgggtatttttctgtataaattgtttgtatattctattagatctttttttaagtttattttttctatttctttcagttgaatatttttattattattaatgtatttgcaaatcaaagtactatcttctttgtatattgcctttgagagtaaatttatttctttgttgcttctgaaattttctttaagatcttctacattatcgctatttattttttgtattcccaaaagacttgaatatacatttccttcgtttactgacgggagttgatttttatctcctaccattattaacttagtggttattggagttgctttcagtagttttaaaaaagtatgtgcatctaccattgaagcttcgtcaattattattacgtcaaaatttaattgattttcttcatcatatagattttttttgtttatgaatttgattcccaatagtttttggattgtattacattctatttctaaatttttgaatgaatagtcgatacttgtttgcagccttaggctagcttttcctgtaggtgctgtaatggctactaatcctttttttttattgtttaatgttttattaattgcttttaagatatagttaacagttgttgttttgcctgttcccgggcctccgcttaatagaaagaagttgctttttaatgcctttctcactgatgtaatttgctctttatttaaattattggtatttaaatttgatattatattttgtattttattgtcatttaattcgcttttatggttttctaatctttttataatttgttttattaattcttcttcttctctgtagtttttttgagtataaatgtaaatattgttttccaggattaggggagttgtaattttaagcttgttaaattccattagtatgttgtttttctttaaaagtaaaactatattcttaatagtttctagatttccaaatgtttctagcccttttagtatttttattaatttgttgtaacttttattggttttttctaggttgtcttttgtgaatattattgtattttgaatatcttttgctaatagatttatgtcagctcttaaatggcctttatcaaagtagttaaataaaaatattaaaaatattacaatattttcattgtttgtggatcttgcaagtgtttgtgctttataacaattttttttattgatatttaaaagttcaattatttcataaagtttaagctcgggggttaagaattttttgtttttatcttttaaaaattctcttaatactaaaaaatctctcataagtgtcttttaatgcctaactctaagatgattttatctaaatccacgtcgttaaattttggaagattaaaataaataccattttcaaattttgattttaagcattcaatattgtcttcaaatgctcttgtaaaaagatatattattccaccaaatttttgattatattcttttttgtttttaaataatattttttttattccaagggcatatattttatattgcaaatcataatattctttttttatcgtattttctaaatttgttatattataatcttccttattttttccaagatagtttgttttgtaatctaggatatatattttattattagctttaaatataagatctactattccctttaaatatccatcacttagttttatgtgaagatcttcaaagtgtttgtcaaaaagatatttttgtttttgaaattcaggatttatttttattaaaaattccatttctttttgtaattcttcaatatcacacagacgagtattaattgctcttatattataagttagtatattataaatcattttagctaatgaattttgtatttctattgtattgagatttgagttaattttttgtatttgtttttcaataatttcaatgttattttttttaaaattatcaaatgtatcttttgctgtgctaaagattatttcctccattgctgcatgtaaaatgtttccgatgtcttttcctttgggcagagtctcttctaatccaggctcataatcaagttctgtttctttttcgtagttaatatttttaaaatcatagttttcgtaaaattctttatgatgagcttgcgctgttaaacttgaaaaactagatgtatattcttttttaaacatgtttttaattattggttttggcggaattaattttgtatttacatttgtattgtatttttttttattgaatctcttttggccaataaattcatgtatgttaaagtcatgtttaatatcatcgatagtaaaaatttttgctatttctagtaatttgctagttatgctatttatttttataataaaaagagcaaatttagctcttgttgctcccacataaaatatatttttttcttcgcttagtatttttagtcttgcgtattttttattttcttccaatttaaaaaaatcatattcaatttttccgtcttgataaaatttgtaaaattgatttttttttgaaaaaaaattgctattttctattggagttgtatttagtaagaatacaatattcatgccaagcccttttgatttgtgtattgtcatgagttctatagattcattatcattatttatattatttattttttcttctatttcttcaggttcttcgtttattattaggctttctaaagtagagattagagattgtatgttttgttctttatgatatattttagagatgatctcaagtgttgtttcataggtttttaaattttcaagcttaccttctttaataagaagacctttgtaatttattttattttttgcccattcaataattttttgatctttggtgatatttgcaattttgatccacaggtttttttcgaatgtaattttgttaattgcatttattaatgttatttcatttttttcaagcaaaactattatattttcaataaattcttctataaggcaaattttgtcttgtttgattaaaattctttgtaaattccacggcacatttaatattttgctgcttagaatataatttagagttttaaaactttgctttcggtctaagcacttaataatataaaaaatttcgctaaattctttggtttttaaaaatttttcttgagttttgtttgtttggatttgctctttttttaatgctttatctattaaattgatttcattttttcctctgcaaagtactttaatgtcttgcattttaatatttctaattttattgttctcagcaatttttccatatgcaagcaaatattttattgttaatgctgttttttggtaaatgtcttcttcgctttctgtatttgtggttattatattgattccttctatttcttgtccgttgatgacaattttattattgtcgtttttttgatttggaagtgaattggtaaaatcaattttttcaatttcatcggctattgcattattgtatatattattaaaaattttatttaaaggccctatgagttttttacttgatctgtgatttatttttagtacaattctagcgtctgtattgattttattttttatttctttgttataaaatgaaatgtctgcttttctaaaggaatatattatctgttttggatcggctatgaatatcaattttattcctgctgtttttaatattttaaatatctcaatttgtattaggcttaaatcttgcgcttcatcaattaaaatgattttgtaccgatttttgattgcatttagaagctttttgtcttctgattttaagtaattttttaaatttgaaattatgtaattttgatctattgtgtttgttgatttaatagttttctttagttctttttctatatattttagtattttgtattcaacttttaaaatgacatattgctttaaattgtttctatttttatttctattgtcttctgatttatatttttcatgtttaatattaattcccaaacagattaaatcatttttaatcttaagttctttaggcgataatttagaattttttttagtttctttttctattagagttgaaaaaaatttattttttaataatgtttctgctattttgaatatgtcgttttctttagagtattctatttcaagtttgccagtttgaatatgtttattataaaaacttaatatttcatcttttgtcattttatctaagtcttctattattttgttgtaatctttgatcagctcttcctttttaagaagaatgttttcaaaagccgtttgggttttaagccaatctccaagctcttgagtcgtatctctttcgtaagctttttttatttttaaaacaatctcttctgtttttttagcatcagatttaaacactttaagttcgtagtctttaatatcaagagcttgaatcaagctatctgattttcttaaaaagtcataaactatttcatctatttcttttgaaaatttttctttaggtttatatttggagtaattttctgtttcaatttgaaaattatttaaggcatgtaatgcaaatttattgattgttgatataaagagtttttttgattgctcataagcttcttttaagatttcatttgtttttgagttagaataagcattttctattacttttagtattcttgtgtgcatttcttctgtggctttttttgtaaaagttaataccaagatttcatttatggagtatagcttggtttttattaaatttataaccacattttccagtatgtgagtttttccggtgcccgccgatgcttctattaatattgttgtgttattttgaattttttctaggattttgttcatgaattttaattttttgtccttacgaatttaatgtaaaatttttctatcaatattaataaatttttgtctaacttgaaatcatgagtgtctttaaatctgttatagtaatcgcagagtgttatttcgctagtttttaaaaatctctcgtgtgctttgcttgtgaaataagctttggaaggattttttatctgcatttttattaaattcttaaaacaatttgaaaaattattttgatttatttttgttaaaattttaattatcaagctttggtaaattggagttggatagcttgatatgtatgcaaattgcataagcatattttcaatgtcatcaattattatttctttgtgatgatagcaaatagttgttttttgcagttaagctttcaagatcaatttttacttctgttaatgaattgaagttttgtatttctttttttattagcagtcctgttatatataaatctatttcattttttattttatctgggatactgcaatagtctttttttacaaaatttaaataaaaataattgttttcgaccttatatacattctcgatatctttttttaattcaaattctatatttttattttgaaaatttagttttatttttttgcaaaatttaattttgctttttgtcattgctgaaagcttttttaagctttcagcagcattatattttaatttatttattttttttaagatttcatttacagtcgttttttgatctatgttgaaaggaatgcttccttgttgtatttcatatctaatgtggtttttaataatttctattgcttttcttacatcatcttttttccccattatgtattcatgcagtagtgttgaattttttataagtctgtaaataatttcaataacactgaaaatttgttcttcttgtttttctttgatttcattttccaatcttatgtcttgtattttaacgtttaaagttttttcgtaaaagtgcttgtaaggattggaaagggcgttttttaattcgtataaatttagcttaattgggctttctagtttaattttattttgcttgaatccaattggtttagaattttgtagtatttttgcgatattataggcttctggatcatagtttattaaataattttcttttgcatctttaaaatatactgggtcgtggttttcatttggatgcttttctatttgaaaatttttttcatacttttgtatgtgttcaagtattttgtttattgtttttgatgtattaatttctgggcttaagttgtcttgaaaggagcagtaaagataaaatttttctgatgttgcaaaaatcaaattaaaaagagccgttatttcctctttttcagtattctcatgttcatagtattcatttaataaattcatattatcataatttatcttagagttgaatttttgaaatcccaaaaaatgaatttcttttttttgaagatattctatttctttgtaattggcaatcaatatcccattttttttatacattactccgtatttttctttttcaagactttcttcaagcataatcttaaaaagataaaattcaatttttatttcattaatttcttttaaatagtttttgtaaagattgtcatttaaatctttggggaaatttttaaaggattttatcttattttgtaaatattcatcggttgtattaaaatcttcaagatcaatatatttttgaataaaaatttctatgatttctgcccattcatatactttgtatgctttatttttaaaatagtttatatcttcatacaaactttttactattgttataagtttcattattgactcttgatcttgaaatcttgtgctttctttttgggtttcctcttcgtatttttcgtcaaatatttcagacattaaaaatcgattaaatccatcttcccatgagtttaaaaagttttgatcatagtttagattttctttgtgagttttgtttgcaccaaaactaatgttcatcgtatcgctaaattctattaaatagtttaattcagatgttgatatattaaattttttcattactttgttgttacttagtaggtcaaatacttcttttctgctaaaattactaattgttccgttttttgatacgaaaagatccattagcctttttaaagctattatactttctcctcttgacaaattgttataacatagaacgctatattcgatttcatatttatttagacattcttctatatatggcaaatattcattaaatttttcttgcaaacaagttattgctatgtcgcttaattttaggttatttttttgcattgagtgtactatttgatttgtcaaaatttctacttcacgtttttgatttttagcttctattattttaaagctatcgtctaatgttgaaattggagtttttgctatgatattatttttaatgcttgttaaaaaattttcacctttaaataattcaatatctactttttctaaagcttgatattttattgggttgatttttgtttttgttaacaacaattctttaacaagagtagattcatagtttagtaaatcttcaaaaattaacacatgcacttcaaaatcaaaaattttttctaaagagttgagaatttttttctcaatctctctgttgttgccaataaatattatttttttaatttcaatttctattttttttgttggtttttcctgaattatttttttatgtaagtttaaaatatttttttgtttttcaaagagctttttaaatagttctttttgcatattttcgtagggttttaaattttcttcttggaataaaaatccattatcttcccaagtttcaattaattttgaaaattttgagtaataatggtggaataaatctattatttttgatgcaaaaaagtacctattctttgtggatttgaaatcttttatgtattttagtttttcagttttcaatatgttgtataaaataaatttttctgtttccaagtaaaatgaaaaagtattctcttctatgtatttttttatattgggatttttaaaagaaatttcatatatgctttttgcggcattttttttaatatttagattataagaaatcccatttagttttgctatggtttttttaatttcttctcttaagagatcattttttactatgatgagtgtttcttttttaaaaatattgtctttttgagttagttctttaattttattataaattttatttactttgttagttttatatatatacatatattaattgtttttgatatcttttgtgagtttgttttttaactttcttaagtttttactgatacttactttatatatgtggggattaattattcttttgtacgtatgttcaagtttgcttaagtcgagtttggttttatttctaatattggttaagctagactcgtagcctttgcgaagttttccattttctaagacagtgtgcgttagaaattcaaaatcgtcatattgtttgatgattttgaaaatgttatcttgtattggatgaaaaacggtaaattcttttcttgaattcagatgatctttgattttatctttttcttcttttaaaaatataaaatcaaggatcatttggtcatttaaatagattcttgcaacttctttttggtcaggtaatgtggatttttctgcgttatttgatatttttatttttggtataaattttccatttttttctatagagatcattttatatactcctgaaaggcttggatctccttttgctgtaactaaatttgttccaacgccccaaatatcaattggagcatttattgaatttaagtacatgataatattttcgtcaagctcattagatgcaataatttttacatgatttaatccatttcggtttaattcttttcttgctgctttacttaaatattcaagatctccactgtcaattcttattgaaaaattatttttttcttcatgttttaattctttgaatattttaatggcattttttaatccactgttaagcgtgtcgtaagtatcgattagcaaacttactttgtttggatatgtttttgcatattctctgaatgcttgctcttcggtttcaaagctcattatccaactatgagccattgttcctgtaactggtatattgtatttatatccagcaagcatattgcttgtgaaatctgctccccctatgtaggcggctttgctggcagaaagtgctccatttattccttgagctcttcttagcccaagttctgctaaaatttttgcaccagattcttttattctagcggtttttgttgctatcaaactttcgaagtttattatatttaacactaacccttctattaataataattctattaagtgtccttcaatcacaactactggtgcttgggggaaaactattcgaccctcttctattgagcttatttttacgtttagtttgaattctcttagaaagtttaaaaattgtttatctaatatattaaagctttttaaatatttaagttcattttctccaaaacgaatattttttaattcattaatcaatgtatgcattccagctaaaacaatatagccatttttaaagggtgtttttctaaaaaacacttcaaattttgctttaggattaattccttttgtaaaataagcgttcatcattgaaatttcataaaaatctgtaaatagtgatagatttttcattctccttattatatactagttttgtttataaaaaaatgatatttaatttgagcttaatttttgtctgctaatctttatgaatatgttttttgtgatatataataaattgaccagattggactaaattctatgaaagaaagaagtgtttctaattttgatattgtaatttttggggttaccgggaatttgtctagaaaaaagcttattccttcactttttaatttatttaaaaataaatgtattagcaattttagggttattggtttttctcgtaagatttttacagataaagaatttagattgtatattaaagattctttatggcaggaagagaccgattcgttgattgagatttttttaaatttttttgtttatgtatttggcgattttaatgaaaaggagtcttataaaaatttatttaaatttttagatagaagtcgagaaacgatatattatctttcgacgtctcctgcattttatggacctataattaatcatttgaaaaagtattttttaagcgaaaaattgactttgtcaaaaatagttcttgagaagccttttggctctagtcttgagacagcaaaaaaattaaatagtttgctttattctgcttttaaagaagatcaaatttatagaatagatcactatttgggtaaagaaacggttcaaaatatttttacatttagattcggcaattctatttttgaaaatatttggaataatcgttatgtagattttgttcagattacggtagcagaagaattaggtcttgatggaagagtagagtattacgattctgttggcgctttgaaggatatggttcaaaatcatattttacaattgttaagccttgttgcaatggagtctcctattaaatttgattctgagtttattcatgatgaaaaagtaaaagttttaaaaagtttgaggaaaattagcaaagaagatattaagaattacattgttaagggtcaatatataggctcacaagttcaaggggtttttaaaaaaggctataaagatgaaacagaatttttgggaaattcaaataccgaaacttatttagctatgaaagtgtttattaataattggcgttggtctggggttcctttttatcttagaactgggaaaggtcttgctaggaaattttcagaaatatatattcaatttaaaaaaccgagctttactctttttaacaatagttctgttgatttttctaatgctttgatatttagaattcagccaagggatggaattgaaatcaaattcaataccaagaagcccggatataattatgaaattcaaactgctaatatggagttttcatatcacggagcatttaaaagattgtttgatgaggcttatgagcgtttattgttagacgcttttttaggagatggtactttatatgcgacaagtgatgagattgaaagttcttgggaatttgtttcagatattgcaaataaatgggcagatattgaaatttgtaattatttttatggctctgaaggaccaaaagagatagactctattttagaaaaagatcatttttggcgtaaaatttaattttctagttttttaaaagatattttttaaatagataaatgagatagaatttttatataatttattcctatccctttttaatacttgagcccccaaccccaactctgtgttctattattttaatctagctaagagttttaaggatttttattcttgatttgattgcaaatttatgcatcgattaataatttgcgttatgattaaaagatataagtaatttttttataaaaacaatgcttatatttaaaggatgtatatggaaaatattgaagtaagagggcagccaaatttttttgggcttattcctttttttgtttttattattatctatttaggcacggggatttatttgggagttattggtgtagaaatggccttttatcaactgccggctagtgttgcaatgttttttgcttccattgtttgttttttggtatttaaaggaaaattttccgacaaaattcacatatttattaaaggagcagctcagtacgatattatactaatgtgtcttatttttatgctttcgggagctttctcttctctttgtaaagaaataggctgcgttgaaactgtagcaaatttgggaattaaatatattaatcctaattggattgtttctggtatattttttgtaacctgctttctttctttttctgccggcacttctgttggatctatcgttgcaattgctcctattgcttttaatattgctgttaaaagcggcattaatccgaatttaatagcagcatctgtaatgtgtggagctatgtttggagataatctttctttaatatcagatacaactattgtttctagtcgaactcaaggtagtagcatcttagatgtttttattagtagcagtttttatgcttttccatccgccatactaacttttttttcttttttctttctttctgaaaatttgtccaatgccacaaactttttacacgaaagttcaatagatttagtgaaaactgtgccttatttaatgattatatttttctctttagctggaatgaatgtttttatagttctttttttaggtattctttctatatgtcttattagcgttttgtatggtaatttatactttctagatgtaatgaaaaacattaataaagggtttttaaatatggcggatttgatttttctttcaattttaacagggggagtttcttttgccgtgattcataatggaggctttaaatggctacttattaaattaaaatccttgattagaggaaaaagttcagcggaattttctattggggcttttgtttcaatagttgatgtttttcttgctaataacacaattgccatacttatttgcggcaaagtagcaaaaaagatagcttttgaaaataacatcagtgttcaaagaagtgcttctattttagatatgttctcttgtatttttcaaggcattattccttatggtgcgcaaatgattattttagtgaatttttcaaatggacttgtgtcgccaattagtattttgccatttttagtttattttggatttttattgttttttgttattttatctattttgggccttgatataaaaaaagtttttttattttttttaaaaaaataaaaattttaaaaattttaagatttgcattgtttaatttttttgattttatttagaataaattgttcttaattatatgatttaggagggttaaaattggaaagagatttgaaattagaaagagaaactaatgtggttccaaatttttgggggcttatgcctttttttctttttatagggatttatattggcacaggactcgttctttattttaatggtgtagaaagggcattttatcaaatgcctcccgtagttgctatgtttattgctattgttttgacatttattatttttagaggatcttttttagcaaaaatgaataaattcattgagggatgcgctcagcaagatgttatttttatatctttaatatttatgttatccggtgctttttctgctgtttgtaaagaaataggaagtgttgatgctgtagtaaatattggtcttaaatatgttccattgaatttaatagtatgtggcatttttttaattactctttttttgtctttttccactggaagttttatggggactattgttgctgttgctcctattgctttggagctcgcagataaggtaaacatcccccttccattgattgctggtgctattcttagcgctggtgcatttggggacaacatgtctttgatatcagatactcctattatttcaagtcatactcaaaaggttaatattgttgatgttttcaaaaatggagctttttatacgtttccagcagcaattttagcaagcattgcttttgcatttttaggttcttattattgcaaggtcgatagttttattattgagcctggtgagataaattttttcaaaattattccgtatatttttgttatggtttttgcaatctcaggctttgatgtatttttagccttgtttttaggcattgttgttgctggtattattggaatttattattcagatattacttttttattgctggctaaaaaaatcaatgaaggatttttaggcctaggggaaatgtttattcttgttatttctactggtggaatttcttatatgacaattaagtatggggggtttgattggttgctcttaaaattgcaaaaaatgtcaaagtctaaaagaacttcggaatttgtcattgttgtcttagttggcattttgaccatgtttcttgcaaataatgggcttgctattttaatgagtggttctgttgtaagatcaataactaaggaaaataatttaaactcaaagcgtattgcggctttactttgtatgtcttcgtgcttttttttaagtattttgccccatagtatgcatgttatagctcttgtagattttacaaaaggcaagctttctccttttgacatttttccatttttaatttatcaaggatttttgatcttattgattgctttgtctataattggacttgatattaagttaatatttaagtcttttttaaaaatagtcacaaaacttaaaagctttaaattttaaaagcttttaagttttttttgaatttaaatatttaagaagacagatttaaatatattttaaggatttcttcttttatttttttaggtatttttttaaaaatttcaaatttggaaaaatcttttggtaaaaatttttcttctaaatataatttcatttcggggttattttttgcctcttcttctattctttttattacgtttttgtttggagaattatatctagtttctttgaaatttttataagatggttcattctcgtataaaaagtttatgaatttgtaagccaagtttttatttggagcatcaataggaattacaaatgcgtctatccatagattggtgttttcaggtgcataaaaatctaaatttttgtcttttagcatagcgctttgtgcttcgccgctccatgtgagttgaatagatgcttctccatttagcattaatgattttgcaggcacatctgaaaaatatccgattaatagtggattttggatttttaaaagttccccagcttctttaattttatctgtatcatgctcatttattgagtatccaagtttttttaaagcaaccccaatattgtctttaggggaatctagcattgtaatctcttttttatattttttattaaataatatgtcaaaaccttgcatgtcatttaaatctattttagttttattgtaaagtatgcccattaatccccagtaggctggcactgaataaagattgccaggatcatgttccaagtttgtaagattttgggtaatattttttgttacatttggcaattttgagtagtctaatttttcaattttgccttcatcgattaattcttggattaaatattctgatgggactattatatcgtagtaattctttgtgttgttaaatttagccatcatttcttcattattgtgaaagatttcataattaatttttatattgttttccttttcaaattgatctaataaagttttgtcaatatattctgcccaattaaatacgtttaaagttattgtgtctttgttagtgcaagcaaaagttgtaagaattactattaatataaaaatttttttcataagtactcctttttttcattttaaagctcagcatctgttgtcaattttttaattcctataaatttattaataataaacaaaaggctcaatattgtaaaaaacaatattgcagaaatagcatttattacgggtttgatgcctctttttgttagcgagtttattaggatagataaattattaaatccctgtccagtggtgaaaaatgatatcaaaaaatcatctattgataatgtaaaggcaataagggccccagttgctatgcttcctgcgatttccggataaattatattgaagaatatttgaatttctgaggctccaagatctttggcagcatcaataatatttttgggaagagaatataatttgggtaaaattattattactacgtatggtgttgaaaaaattatatgtgatattagcattgtagaaaatcccaattgcatttttattgcagaataaaatgtcattaagcttattcctgttacaatgtcaggattaattattgttattttatttactgataatagtattgtttttaattttttgttttctgatttataaattgcataagcaccaataattccaataacaacagaagtcaaagatgagattatggctattaaaatggtgttaaatattgctgatttgatttgacttgaggcaaaaatttctttataccattttagactaaatccttgccatataaatccactgtcaccagagttaaaggaataaattattaagattattattggaaggtaaataaagctgagtattagaaataagaaaatgtttttaaaggctctaaacatattttactccccattattttttcgcattaattttattattattaaattaaaaattaatattactaacattaaaataaatgaaattgcagccccagtattccagtcttctataaagagaaactgtttgcttattagatttcctattaaaatttgtttagagcctcctagcaaatctgaaatgataaataccgtaattgaaggaataaataccataattattcctgttgccaggtaagagagtgttagtggtatttttatataaagtaatatttgccacattcttgctccaagatcttgtgatgcttcaatatattctggcttaatttttaaaagccccgtgtatattggcaagatcataaaaggcaaaaaattgtatatcatgcctattgtaacagcctgttcattataaagaagatctaaagttccaattccgatcttttcaaataagttgttgatgaatccgttttttccaagtattctcatccaggcataagttctaagtaatgtatttatccacataggaagtattatcatgattattaatttgttttgagcacttttttttgataatgaaattagccaagcggcaggatagcctattaaaatgcaaaaaattgttgctattgttgcgagttttagacttcttgaaaaaatattaagatagcttggatttaaaagtccaatgaaattatagatggtaaattcgtttttttcatttaaaaatccaagcaatattattattagtaagggaagaatactaaatgttagtaggaatatggagtatatgattaatatcaactttttcaaaaccattattccttatgcataacatgaatatcatcaggttctaaaaatatatcaacttcttctccaacttttgtaagtcttgtgctttgaactatccaatttgttttttggatttctagagtcatttcgtaatgaactccttgaaaaattgctgatgttatagttccgcttaaatgtccttttccttttggaagtagttttacatcttctgggcgtattacaaggtcaactgcttcttcagcttcaaatcctttgtcaaggcattcaaattcatgaccaagcaaacttacaaccagctcttttttatatgttccatcaaaaatattgctttctccaataaaatcggctacaaactttgttttaggctcattgtaaatttcctcaggtgttcctatttgcagaattattccttcattcattacaacgattctgtcactcattgtcaatgcctcttcttgatcgtgagtaacatatatgaatgtgattccaagctgacgctgtattttttttaattctttttgcatctcttgtcgcattttcaaatcaagcgcggaaagtggttcatctaggagtaaaagcttaggttccattaccattgctcttgctattgcaactctttgcttttgcccccccgatagttcgttaatatttctgtatgcgtattttggcattcctatcagcgaaagcgatgtttttactttttctttgattatatcttttggcgtttttttcattctaagtccaaatgaaatattgtcaaaaacattcatatgtgggaaaagtgcataattttgaaatacagtattaatttctcttttgtttggactggttttagatatttctttagaaaagaaataaatttctccatttttttggcttaaaaaaccacccaatatttttatcaatgttgtttttccacatccggatgggcctagtagtgtgataaactcattttttttaatttttaaatttatgttatctaaagttttgtttccattgttatcataataatgacttagatttttaatctctaggatacaattatccaactaattccaacctccttatggctgtattaatacaaatcaagattatacttaatattattatttatgtaaatgccttttttaaaaggcattataattcttatcaagaattattttgccaaatttaccctctctaaattctttgattaatatttttgatgctttttcaaggttaagttcattttttttaccgattaattttcttgcttttgcaaaattttgtagaatatcaagtgaatttttatgatatatttcgtatttttttagtaaaatatttttattattttgatccattatttcaagtaaatacaatgcaagatctgtgttatctactatttcatttttgatcatatccaatattgcaagtttttttgcaatcgattggtctactagattatgccataaaatccctggcatatcaaaaagatttatttcttcatttatttttactatttgtatatttttagtatatccaggtttattggcaacttttgcgctctttttgccggataatagatttattattgaagattttccaacatttggaactccaataatcaaaacctttattttttctttatagttttttatctttttaacaatggccaattttttaataatatctattatctgcttacgcattccttttttgtaaatattgcttattattacagtattgccaagattttcaaaatattttttccattttataatttcatttatttgagcaacatctgatttgtgtagaagaattattttagcttgatttttagtaattttttcagttaatggatttttactgctaaatggagctctagcatcaagtatttctagcacaatattagctttttgtaaattattctttatcagatctaaggcccttttcatatgtccaggaaaccagttgattttatttgccatgcctaaattatagcttaatgtgtattgaatgataaattgtttttgtttttagtttatgttagttttctttaaaagaattgtttttttttaaataaaaaatataatctgtatttaagtttttatattttttaagaaaataaattttacaggaggtttgattattattgtaaaaatcaaaagagggttaatagtatcttgtcaagctcttgagaacgagcctttacatagtagttttattatgtctaagatggctttggcagccaaaataggtggagctattggaataagagccaacggagttaatgatattagccagattaagttggaagttgatttgccaataataggtattattaaaaaaaattataataattgcgacgtatttattactcctaccatgaaagagattgatgagctttgtaatgagggggtagatataattgcccttgatgccacttttagaaataggcctgatggcgtgctacttgatgatttttttgaaaatattaaaaaaaaatatccaaagcagtgtttgatggcagatatttcttctttagatgaagctattaatgccgataaattgggatttgattttattggaacaactttgtatggctatacaaaaaataccaatggtttgaatattgcagacaatgattttaattttttaagaaccttgcttaattctaatttgaaatctactttaatagtggaaggaaaaatagacacccctttaaaagctcaaaaatgctttgaaatgggggttgatttagtggttgtagggggtgctattacaaggcccgctgagattactaaaaaatttgtagaaaaaataaatcagattaaaaaataattttaaacttaagggttaatttattttttattttaggagggttttatgttaaagggttttgaacaagctcagaaatttggacgttcttttatgcttccaattgctattttgccagcagcggggctgcttttaggaattggaggctctctttctaatccagaaaccgttaggacgtattcttttttgaatatattcttcttacaatcagttttcaaaataatgagtgcgtcgggttctattattttttcaaatttagcgccaatattttctattggaattgctgttggacttgcaaaatcagataaaggcacatctggaatcgcagcatttattggctaccttgtaatgaatgctactattggagttttaattgatgtgtcaggcagagcggagtctttctctagtggtgctgtgggttttgttcttggaattaagactttagaaacgggggtttttggcggggttgtagttggtattttgacttattatcttcattctagatttaacaaagtagatttacctaaggttcttggatttttttctggatctagatttgttccgatcattgtttctttttctagtatttttcttgctgttattatgtttcttgtttggccatttgtacaaagtggaattaataaagtagggggcttagtagattcaaccggttatattggaacacttatttatgggatttttttaaggatgcttggaccttttggtcttcatcatatattttatttgccattttggacaacaggccttgggggatctgttattattgatggaaagttaattgaaggaactcagaatattttctttgcagaacttgctgcccaaggtacagatagattttttatcggaactagccgttttatgagtggacgatttattaccatgatgtttggtttgcccggagctgcacttgctctatattacactgcaaagcgcgaggagagaacaaaagtttttggtcttttgatgtcttcagcgctaacgtcatttttaacaggtataacagaacctcttgaattttcttttctttttgtagcccctattctttatgttgttcatgctacatttgatggatttgctttcatgctagcgcatattttgcaaattacaataggtcaaacgttttctggagggtttgtcgattttattctttttggcattttgcagggaaattcaagaactaattggcttttggtgccagttataggcattgtttggttttttctttactactttacttttatatttttaataaataagtttgattttaaaactccgggtagaacgcaagatttaaattctgaagattctccaagttctaagagtagtgaatttgaagaaaattatgccactaaggttattattgggcttggtggtgcttcaaatattgttgagcttgattgttgtgcaactaggcttagaattacagtaagggatgttcttaaagtttctgaaaaaattttaaaaaaaactggttctaaaggagtaattattaaaggcaatggggttcaggtagtttacggaccaggtgttagtgttcttaagaatgaaatagaagaattgctagaggcttgatttttttaataagtaatagcttaaggctattacttattaatcttgtttatgaaatcaaatacatactttgtgaagtatgatgtgttttgggcgcttttgtagctttggtttccaataggtaagtgagcgtgtgaattttcaagaagtatgatgggaatatcctttttttcacccccataattttttataaattcgtttatttttattgggtctactgtatgatcatttggtgtgtgggttattattaaaggtattttgatttcgttgaaattatatgaatttaataatgtgacaaggcccatcattgcaataattgcgtctacatgctgtactcttgaagagtggctttttatagtcgggtgttcttttcgtttatactcttttgtttcgaatttattgtagccacctgttataagatatgcaatttgtcgcccccaaggatagtaaacgatatttgttctcttgtcataagggaatatattaggagaaattaataccgccgagtttatttcatttggatagtttgccaaggcccagatgctggcagtgcccccattagaggttccaattaatactaatttatcacctattaatttgccaatgttaatagcctcatcaatgtctctcagccaatcttgggtagttattccccgaaatgcatttttattgttaattccgtgtcctttaagtcttgtaaaaaaaatatttgcattaagagcttttgcaatattatttggaaccggataaatttcattttttgatgctccaaatccatgaatatagaccacagaataatttgttttttgtgctttttctttataccagattatttctttttttgtattgctttctaaattaaattgcaattcttcttttaataagtaattgtcaatttcttctatgtttttaggaatcagtttttttgaaaattcatttttaaattttatcctcggactaaccagtattaagagtaataagaatataagtataaaaatgatattttttatattcataaagtgatttccttgttctcatctgggacattattgttattatgggtatcttttttgtagcaattattgcaatgccctgagtaaatgatttcaatagattttgtttcccagttttctccaagtttgtctttcaaaatatctttaatatcgtcaagttgaatagggtggacttgattgcatttattgcatttaaagtgagctattgtggaagccaagcttagataaaattttgtttctttttgatcagtagtttttatatcttttagtatatttctttcttttagaatatttaatgtgttatatactgttgcttttgataggcttggaatttcttttataagtttgttataaacttcttttgccgtaaagtattcttttgggtttgatgctatgtataaaatgattctgtttctcgaatgagatgctttcattcctaattctgatgttaaatttttcaataatacaggatcgtttgtaatgccgactttttccaatgcggaatgtacgtctattatgttgtcgttcatatgattataccttttttgtttaaattaaagattaaatactttttatgttcttcttaggataattttatacccagttattaatattttactacttattatttatttattttcatatttttttatattagtataaaaaattaaattttttatttttgaattcagttttattttgttatcaaaattattatttaatggtagtatcattaaatttagtgtttgagagtaatttattacatcttggatcttaactgtgttataagaaccccctatatttaaaattaaccatttcttagaatttattttttcaattttataattaattgtatgaatgatatgtttttcaacatttaaaaagcttataaaaaagttgctgtttttatcatttcctttagatatcaaaaattctgtgccattaatgtagcctttgggattgtttttagttattattattttttcataagtatcaagatcgctgtattttgctgttatttttaaattagtgccttttgtaatttcaaaaacaggtatttcaagagctgaatattcaagaagataatcaggattgcatttttttaatgtttttttatctagatctattttagaaggccattttattttaatcgatataaagaagctagagatagtctcatctataaaaaaatcaattgttgattttttggcagagttaaaagctaaatattgttttattcctaaaattttttcatttgagaatgaaaatgaactttcaatagatgcttcttttattagttctttttttgatgaaactttaaaataggttctagatgtgtttaaaaattcaacttttttatctttaaattttattttatttaattttccattttcgaatttgatgttgtattgatcgtgagatagcgtgaaatttccttccatattgtattctaaatttttaggcacaattgattctgaatttttaatgatttcatcttggtgtttatttattaaaaattctcttaagcttttttcgttgatttgataatctttgagtcttttgttttgaaaatttattattggctcttgctctttaagggagttaaattttggaatctctagtagttcggtggtaagtttggatccttctagattttgtattttaatgctgtgtaagttgttttctagggcttttaaataaagtaaaaaattttttagttcttgattatcataagtttctttgatctcataaaaataaataagagtttctacgttgctttttggagaatctattttttgtacttcatataaatattggcagttatttttataaaaaattaaataatttttattatttttactctgccttattccttctgtataattgaaattaagctttctgtaaagctcagtcaccttttttctaaacttttctatgttgtatatataaaacataataggcgtattttgaaatatgtctttgtatccacttttgaatggattttttagtgcccaatacaaatctaaatgtatttcatcgtgtagcatgtattcatgagggcttccactgtaagttccaggcatatatatatctgtattggttttgaatctttcaaatagccatttatttaattcctcatgttctcttagaatttcaaaaaagtatattggaaatgtccaatgtattttgtaagctagctgtttgtgttcaatcaaatattttatatttgatattattaataacaggttatcttctgaaaatttagttattgaaataataataatataagttttcaatttttttagttttctaaacataaattctttgtctttataatttaaagattagtcaatatttacattatataataaaaatttttactggttttgtatattttgtattttttgatgcatagaagtaatacgctactatagcgaatgtattaagtttatgttaatcttatattgttatatgtaaattatttttatttatagaaaggggtaaaatttttatggctaaagacatatattttaatgaggatgctagaaaaagcttacttagtggcgttgaaaaattatccaatgctgtaaaagtaactcttgggccaaaagggagaaatgtccttattgataaaaagttcggctctccaacggttacaaaggatggggttagcgttgctcgtgagattgagcttgaaaatccgtttgaaaacatgggggcacagcttttaaaggaagttgctattaaaacaaatgatgttgctggtgatggaacaacaactgctactgttcttgcttatgctattgcaagagaaggccttaagaatgtgtcttcaggaatcaatcctattggaataaaaaagggaatagatcacgctgtaaatttggctgctgagaaaattcgtcagtctgcaaaaaagattacaacaaaagaagagattgcacaagtagcttcaatttctgctaataatgacagttatataggtgaaaaaattgctgaggcaatggataaagttggaaaagatggtgttataacagttgaagagtcaaaaacctttgatactacgatttcttatgttgagggtatgcaatttgatagaggatatctttctccttatttttctaccaataaagaaaatatgagtgttaattttgacgatgctttcatattgatatatgagaaaaagattagttctattaaagagcttttaccagttcttgagaaagttttagggacaaataaacctttattaattattgctgaggatattgagggggatgctcttgctgctcttgttttaaacagcgttagaggagctttaaaggtatgtgcaattaaatctcctggttttggtgatagacgaaaagcaatgcttgaggatattgcagtgcttaccggcggtgttttaatcagtgaggagctaggccttactcttgagacagttgaaattgagcaacttggacaggctaaaactattaaggttgataaagacaataccactattattaataccggcaataaagagcaaataaaggagcgttcagagcttattaaaaagcaaattgaagattcaacatctgaatatgataaagaaaaacttcaagagcgtcttgcaaaacttgttggcggagttgctgttattaatgttggagctgttactgaggtagagcttaaggagaaaaagcatagagttgaggacgctctttctgcaactcgtgctgctgttgaagagggtgttgtgcctggcggtggatcaactcttattgaagttgctatgtatttagatacaatagatacaagtaaattaagctatgaggaaaagcaaggttttgagattgtaaaaagaagtcttgaagagccaatgagacagattatttcaaatgctggttttgaaggatctatttatattcatcaaattaaaacagaaaaaaaagggcttgggtttgatgcttccagctttaagtgggtaaatatgattgagagtggaataattgatcctgctaaggttacaagaagcgcgcttcaaaatgctgcttcaattgctggacttttattaacaacagaatgtgcaatcacagatattaaagaagagaaaaatacttctggtggtggtggttatcctatggacccaggaatgggaatgatgtaaattaaagtttcaccggcaagcttgtgtttttgccggtgaatattttattattcaaaggaattattttgagtgaggatgaatttgttttttgtataggctatgattgttcaaaggcaatagtagataggcagcttttaagagaaaataagggtaaaagtgctaaggaactttttgaacttggactttacagaagtgcctttagcaaagctctttataggaatgacgatggtcttattaattatttaattgaagagtataataaaataagtaactctaattataccaaaaaagatgattttaagcttttatttggagtagtttatcctgatgatattaataagataaaagtgacatatgtatagtatgggaggttttgtgtttttattgcaagaatttagcggcaatagtagctttttacgaagtttattagtttttgtgcctgttattgctatattttggtttttagtgatatctcctcagcgtaaggaagagaagaataaaaaagaaatgataaaaaatctaaaaaagggcgataaggtattaacaataggtggaatttttggagttgtgaaaaaattaggcgatacggatgttattttagaattaagtccaaataacgaagcagtatttataaaaaactctattgataaagttttgtctgaaaaaaaatgaagttaaaaaaaaggtattgtttaaaggtaaaattagaactgttagctaataatggtattttttaaaaattttaaggatttgtataatgaaaaaaggatctaagcttatattgatattgttggtgacgttttttgcatgtcttttaatatttccgactttaaaatggtattttttaatgagcgttgaggataaaaaaataagctcatattcacaagaggccttaagggattattcaaagaaaaaagccctgaatgatcttgttaagcttaaggaactgtataataaagatcccaatagcagtattccagctagtttgtcttatttaattccaatagcaaaaaataattataggtcttcaatgaaaattccacctaatatttttactgctaaaaccttgcgtgaaggatttttgactgattcggatatgggagaagtaagcttagagatttatagatattatgagaacataaagaagggcaaaagcagaataatacatcttgggcttgatttgtctggagggatgagtgttaccatttctcttgattattcaagtgttgaaaaaaaattaggtcgttctttgacttttgctgagagagaggatgccatttatcgaataatgcaaattcttaaagatagggtarataggttcgggcttacagagcctaaaattgtaagagaagccgggggaaataaaattttcttagatattcctggagaaaaagatgagagtagagtaagcactcttttgagcggtaaaggcaatttgactttttatgtggttgatgatgagtctacatctcttttgcatagaaaaatattagaagcgggctctcttttttctattcctgaaattcaggcaagtatgaaccttccagatagtaaacaaatttttccttggtatgttaaagattcttatggtgtggatgatgagtcatcagttcgttattatgtagttgatgcaagccctgaaaattcatttgatggtgctcacattaaagatgctggggtttctaacgatcctagaacaggccgagatactgttgcttttagccttgatgttgatggaagtgaaaaattttttaaatttactcaaaaaaatgttggaaagtctttggccgttgttatggaaggtaaaattaagtctgtggcaggaattggatatgctatcactgggggcaatgtttcaattcaaggtgactcttttgataaaaaagaggctcaagatcttgctttagtgtttaaaactgcagcttttccagttgatattaaaatagatgatttgagaataatagggcctactcttggtgctaggactattgatcttggcattaaagcttctgcgcttgctctttgtttagtttttttgtttatatgtgtttattatggtttgagtggtgttgtagctggattttcacttgttatttataatgtatttttaattttagcgatattgtcggcctttaattttactttaactttaacaagcattgcaggtcttattttgacaatgggtatggccgttgacataaatatagttatttatgagagaattaaagaagaaattagagaaggcagaagatttgaaaatgcttttgaagctggttttaaaaaggcatttttatcaattatggatgcaaatataacaacatttattgcggtgctttttttaactcttcttgggacaggagttattcaaggttttgcttggtctctttctgttggaattgtggcatccctttttagtagtttgattttttcaagatttattttggaatttatcatatctgttagaaaaagcaaatttataagtatatcttggagttcaaaatatgcaaagagtaattaatttttcaaaatatggaagcaatgttttaattgttagtgccgttttgattttggttgggcttatttatacttttttttatcatggtggatacaattggggaatagatttttcttctagggttaatattaatctttcaatagaaaaatcaaatattaaagaaaatgaaattaaaaaaatattctctccgatttataagactttagatgttaatagtattttttcaccagatcagaataaaagtgaattctctattatggtaaagtctgatgtgattgattatgcttttaaaacagaagttcaaaaaacaatattagataaacttaaagaaacatttgatgctaatattgaagttttggattcttattttattgattcaagtttttcttctactttgagaattaggtcaatttttttggtattaggaacatttatcctgattttgatttatataactttaagatttaaactaagttatgctattgcttccatactttcaatatttcatgatatattttttatagttgcttttttaggggtatttagaatagagattaatagctatattattgtggcaatacttaccattattggatattctttaaacgacacaataattatttttgataggattagagataatgttaagcgattaaccgataacacatttttaaatgtattaaacataagtattagtcaaactttatcaagaactgttttgacgtcagttacaacatttgttgcagtattttctatttatgtgtttactgaaggatctataaaagatttttctttggtatttatggtaggggtaattgttggaacttattcttctgtattcatagcgtctccaatacttttaaacctgtataaaaagataaagtagatcttaaataagatgatattgtggcatgaagttttttgattttggttcattaggattttatagattttttgattttcaaaaatatcttaattttagcatttttaggtatagtttaataaattattattcttatcgagaacagtcaagccttattaacgatgctaatttgctaaaagataaacttttgtttttggataagatttatagggattttaatcccagtatcaataaatcttggggtgccaataaagctatttttttagatactttacttattattaaaaatttgataagaaaatatcatcctaattcccaatttttagacattcatgaagatgaattgttagaagatgtttcctgttttaataaatttttagacaagcttaaatatttaaattttagagtagatcttaaacaaaaaattgaaaattttgaaaaaaagagcaaggctccattttcttgcataagaattgccacattttttattcaagaagaatttttagatcgacttagtaattcattggattttttttccaatgaggccaatagtaataatttagatgtaattaataaagaaattaatgattattatgaaaaagtagagcaaattaaaaaaagtagcaatattaaagaaactcataaaaaatttattatagatcacacaaaagagagaattgataaaattatgaaagatcatagtcttgacatttctaaactacttataaaaattgctttgcttgaaattacaattcaatgttttgatagctattatttaaatttattagaaattttacaaattcttttatctattaataatataattgagattggtttaaacgaattaccggatgctatttttaatgagtggaatgagcttatttatttgcgaagaaaagagtttcaaaaatttgttttaatctccgattatgttttccaaaaaaggattgtatctactataaattctggaaattggaaatttgctttttttactcttgctcccagacaaggggatgtttttcagttttcagtggatattgctaaaaattttgataatattgaggatggaatcaaagaatatgaatctaaaataaataaatttaatgaatataggtcgggttgggaggcaaatttaaaaaattttggtcatttattttcagaaacactttagctgtatatctcttttaatctttcgtaaatagtttttacttcattatttattatttttggaatttttactatcaaagtgactttaagatccctttttgagctgcttccaattataggcatccccaatccttttaagtttagaatttctccattttttgcatctgatgggattttaagttttatttttttcccttcaattgtttcaaatagcttttcgcaacccaaagctatttcccaggggtaaacttctattgttgtttctaaggtttttccattcagtttaaaatttttataacttgatatattaaatttgactattaagcttccttttattccagaaattggattaatgggacctttgttgtttatttttattgtagttgtttctaatgttccttttggaattattacctcgatttttttgttgtttataagtattatttttttacttcccatataagcatcataaagtgaaatatttataattatttctctgtctgctgtttttcttgaggatccgccaaagattttggaaaaaaaatctaaatcttcaaaattgccaaatcttgtgctgctaaattctctttcaaaatggtcgttgttgccattaaaatttgtgttacccaaagagtcataatttctttttttatcaggagaagataaaatttcataagcctcatttatttctttaaacttttcttcagctattttgtttcccttgtttttgtctgggtgatattttattgccaattttttgtaagctttttttatttcctcattactagcatttttttgtattccaagtatattgtagtagtctttggtcattaaaaaatctccttcaatctaccttatttattgtattttttaaatatattttaatatttatactttatatatgttataattaaacctaaatttttaaaagaccaattatgagagtagatcttttacctcttgtcgagttaagtctttatattaatttgtcattttgttgtaaagattttagcatttttaatagaattttagaggaattaaaatgtcatttaatcttgctgggtcatccaattataaaaacactttacattaagcacgtagatttttgtttatctaggcaagataatttaaaatttattttcacttctttgtccaagtatattaatttggagttattagaagaatttactttagaaattattccgggttatgttgattttgaaaaattcaaacttttggatgaattttgtattactagaattaatcttaatgttcaaagtttttctttagagtttagaaagattgtggggatacccgaaatttcttataaaaaattgaatattttgattaacaatattagaaagtttccttttgatttgaatattgacatgactgtcaatatgcctttgcaaaaaaaatctcatctcaagcgagatttgaaagaattgctttcatatatgcctgagcatatttgttttagcgattttatatgtgaagaggaaggctttgtcttgagagattttgataacagtattgattcggaaaaactgtggttttgtgctctggagtgtctagaatccaatggctacattaattatgaaattactaattttgcattaaaggggcatgagagcaggcacaataagctaaattgggagttaaagccgcatttaggattaggattgtatgctgtaagtttgcttttttgtaatgacaagaataataatgtaagagctttgattagaaaaactggtagttttgtcaaagcaaataatcacttagtaacgtttgaattgttagaggatttggagttttttgtttatcattttattcaagggcttggaaccattcaaggtgtcagcttgagggctcttaggcttagatttgagtataatgaaaaacaattttttcagtttattaattactgctcaactttaagtaaaaagtttgtttttgatgataatattatgctattaaaagggagagaaaggtttaagttaaatttttatttagtaaaaattataaaccattttaatgataacttttttaaagttaagcttaggcttccttgatttgtttgtcttggtaataaactattcttgtgtttttatggttgaatattccaatctcaagtatacctggaaatagtttgaagtatttttctgttccttcaggattttccacatgcatttttacatctaagatataattattgttatcagttatagtggggcctttcttttctttacaaattctcaaggttgcctctaaattcatttcttcaagtctagtcataataaatccaacagcattttgggcaacttctatgggaataggcatttttgttcctaattttttaacaattttggtttcatctgctattattagcaatgtttctgaattgtaggctattactttctccattagatgagcaccccccattccctttattaagctttttttttctaataaaatttcatcagctccatcaattgcaatgtctagatttttattaagttttgaaaaatttgattcataaggaatttgttcttttgagagtaaatattttgtatcactacttgttgtgtagaattttaaattttttaagctacccgattttatcttttcgcttagatattttattgcataataaatagttgtacctgttccgattccaaggttcatattgcttttgatatagtgatcaattgcatgttttgctaccaaaattttttgattttccataaattcttttccttgcttgataaacttaaagcttaatgtattttaaagtatatcattatttaattactaaggtttaaatcttgactagattttatgctaatttataattattagtattggtaaataaaataatatgctaggagattttatgtataaattagttttagtaagacacggagagagtgagtggaataaagaaaatctttttactggttggacagatgttaaactttctgacaagggtatcgatgaggctgttgaggcgggtttgcttctcaaacaagaaggctattcttttgatattgcttttagttctttgttgtcaagagctaatgacactttaaatattattttgcgagaattagggcaatcttatattagtgtaaaaaaaacctggagattaaatgaaaggcactatggagctttgcaaggtttaaataagtcagaaacagctgcaaaatatggggaagataaggttttaatttggagacgtagttatgatgtgcccccaatgtctttggatgagtctgatgatcgtcatcccataaaagatccaagatataaacatatccccaaaagggaacttccttcaacagagtgccttaaagatactgttgcaagagttattccttattggactgatgagattgcaaaagaagttcttgaaggtaaaaaagttattgttgctgctcacggtaattctttaagagcgcttgttaaatattttgacaatttaagtgaagaagatgttttaaagcttaacattcccacaggcattcctttagtttacgaattagataaagatttaaatcccattaaacattactatctaggtgatgagagcaaaattaaaaaggcaatggaatctgttgctagtcaaggaaagttaaagtaacgatttatttgtattaaagtgtaaataagtcatataattatgacttattttttattaattttaaggcttaaacgtatttgcttgtaatcttttcaaagcgatcaataccaattattttgataaatccagctaatttgggccctttttctttgtcaattaaaattttataaatttgtttaaaaaataaagcaggttctatattattttctcttgaaattttatatatttcgttttgaatgtcttgttctgtggcaacttcaaaatttttctttaaaaaatccaaaagttcattaattgcttttttgctattttcttctagtatttccatattatcaaatttagatcttaatgaaaatttgaaatcttcgggtgcaaaatctcttatccaattaattgcgcaatttattttatttattagtttgtctttttgatcttcttgaacgtttttcaagtaatttaaaattttatttatattattttcaaatatttgactgattacacttaaatgtctgaatccgacctgataagggattcttttgcttggcatgtatggttgagatagttcgtaaattcttttaaatgctctttttttttcttcttttacatcttctactccatagtagattctctcaaatttgtcgtaatcttcgtatattttaattacatcaagatcaaatgagattgaaaattcagtatttggtttagtagcagcaaataaaaaccttgtgacttcgggtgtatagacctcaagaacatctttgagcgatatgacatctcccgatgaggaggatatttttccaccacgtccttttattgaaataaagtcatattgaaatgttacaggagggctaccttgaaaaatttttacaatatttttagatgtatcaaaactgccgccactgctgtggtggtcttttcctgcaggctcaaagtcaactttttcatatttccatctcataggccaatctattctccaaggaagtttaatggcccatgtggttcttatgtctagagattcttgatttccacattcacatgaatactcaacagagtaatgattgtcataattatttacagttgttgtgtctctattgcattttgtacaaaatacactgattggataccaattttcttcaagctttgaggttctgtattcgtttaatgcttcagacagttcttttttatgatcaagtgcaaattttatttggcttgcataagcgttgctggtatattgtttgctttggtcgatgaattcaggattgatcccaactacaggcagatatttttcaaattcaatttcattagcccttgcataacttgttttgtggcttcttgtgtcagggacccttgttattgcttgtcttaaataagttgtaagaagttcttgttctggcatatttttgggaacttttcgaaatacgtcgtaattatcccaagaataaataaaccttacttttgatccagagtctcttagtgctcttgctacaaggtctaccgaaataacttctctaaaattgccaatgtgcacagttccagatggagtaattcccgatgctactgtgtataagttttttggacctttttctttttttattttttctgcgtaaaaatctgcccagtgtgctgttttcacattttattcctaatttaaatttaggtaaattttagcattttgtttttcaagtttcaagaatttaaaaaaatgcagtttaatgtttgttaatttataagtctttttattagcttatcttctttgttccaattttttttaagttttacctgtaagaataggttgcattttgtttcaaaaatttttgcaattgtttttcttgccctttctcctattgattttatttcttttccgttttttcctacaattattcctttttgactttcattggctacaaaaatatttgctctgataaaaagacttccttttttattttctaaggtatcaatatccacatacaaagaataggggagttcttcttttaggttttcaatagctttttcccttattatttcactaattctaaaatttatttcttgatcggtgtagtattcttgtggataataaagtgggccttctgaaaaattttcataaattttattttttagttcttctgtgttaatttttttttcagcagatattttaattatattactatcttctattcctttttcttttagaaattgcgttatttcttttatttttgtgtttttaaggtcaattttattaagtattactaaaaatttaattttagagtttttaattatttctaacattttattttcttcttctccaggtttgtcttgaatgtctattatgtataaaatgagttcaacttctcctattgaagagtggatatttttcatcattgcaatattaaacttttttttactcagatgaaatcccggtgtgtctataaaaataatttgtcctctgtcgtccgtaaagattccttttatattatttctagttgtttgcggaataggggatattattgatattttatgtccgcatattgaatttaaaagggtagattttccagttgatggtctaccaagtattgctgcaaatcccgatttcatgttttagtattccttaaatatgtaatattcatatattttttattataattaattatatagtattttaaatacttatttttaagtaaaatttgaggaattttcgtttggcaaaggtaaattttgaagttttttgcgagcaatgtggcgaaaaagttggacttaatcgatctgtttgtcccaactgtgctgctaagcttggtgatatcgaatgtccaaattgtaggcatgtaggtccagtttctgcttttggagaaggttgtcctaattgtcactacagtccttttcaagaacttaaagaaaagccctttaaaagaaaagaaagagcaagaatggtaagtgatagagcagcttctaagacctttgtaaggcttttccattttgggattaatattgatattttgctttatttattttcaagttttttatttgttatactttttctttatattgtttatggctaaaggctttgtatgggtattacagttttttatttattttctatttttgcatcttttgttctgggttctagcatggattctgttaaagagaatgttctcaagagcactattttttattatgatgttgaagaagttgaatttccttatgctaggaagcagactttacaatttattgctaaaacccatttaaaatatgctgtttttaattttgacaaaaataaaatgttttcgtacacttttgtttttgataaaaaattaatatctcagtatgcaatttttattgaggtaaagaaaaagtttggcgaggctacactagtaacgcctttgaattatttatgggatcttggtgattctattattgttttaaataaaaatattttaagaattactttaaaatcttatatttcaaattataataaatgatttttaataaggctgataattgaaaaaaattttaaaacggtttttgtttttagttttgtcgatgtcttttttatcttttgctgatcatttttacgataaagaaattatgataaatggggttaagttttttgtaaaaatagcatctaatgagcttgatagggcaaaaggttacatgggtgctcaaaaagttgaatatggcaatggaatgctttttgtttttaaaaaagatcaaaatttgtctttttggatggaaaatacacctttgctgcttgaaatagcttatattgattcaagtggaattattaaagagatttatgatttagagccgtactctagggcaaatgttaattctctttataaggtaaggtatgctcttgagcttccaaggggctcattttctaaatttcaaataaaaataggtgacaaggttcatttttgctttgatgttaattctttattagtagaatgattttgaaattattgggctttgatttcttgaagttcttcttctatttgatcttctttaagttcgttattagattcttttgttgaatttgttttttcttgctttaaggtgggctgttcatttgattcatttgtattgttattttcttcattattatcaatgttttcgttgttggttgttattatttttttgaaaatacttattgttgaggcaatctcatcaattgcatcaagcaaaaatgtatcatttgcaaattcttctgcttttacaatatataccaaagagttgattcctctttctgcattatgaataatctcccacgatccaaatactctgttattataactatcgctcataagcgagtcagatatttcttttatttttggtgtgtttatatcaaatactttaacaattccaaatatttctcttatctttgaatttttatatgagtttagtcttgatctgatgattacttcttctttttcgttattgtttatatctttaaatgctataaagtcattttctgagtctattttatattcaattttgtttttatctaaaaattttttaattctcttgtcgtactgtatattcttatgattgcaagaaatgagtgcaaaaatgataatgatcatgccgtagaataatgtattaatattcattattcttgcaattagcattgtattatgtaacatatgattattataatttaattataaggattttaaaagtaatttatgcgtcttccaggtagtggctattcatatactgttattcaatctaaaaataattattcacaaaaatcttcttttggaatttcttttgtaatattaagcagaggaacaaaaatttttagagaagatttgtttgaatttttatcaaattttgactttataagagaaataatttcaattgaaaaacagagcaatagaagttctttgcagtttatttcagaaagttatggtaagttaaaatttattttactttctgacgatttgaattctggggaaaaggttaatttagcaatgaaagaatccagctgtgattttgtttttgttttgcaaagtgatatgtacttgttaaatcccttttggattccaaatatattcgatgaaatagtaaaaaaaaatgttcttcttgttggtggggagttttttgataaagaagaggaaatgattccttcaatttttcttcccagcatagataaaaagcaaaagtttaaggtaattttagtaaattctgagaaagactatgaaaaaactttgattaccatggattattgcggactttattctaaagagaaatttttacagcttggaggttttgacgcaagaattcaaaatgaatattttcaaagaatagattttggactaagagctatttattttggggagcatgtttatatttatagaaagctgagaatccagtatactgcattaaattcgccagaaaatttaaccaaaagcaaaagttttttgatttttttgcttaagaattatgtcccaatttttgttggaaatggcgttgttttttcttttttaaggttttgcaaaatttgtttaaaatacaaaattaatccttttctcttccaaaaagagtttaaggagataaaaggtgagattactaaaaatagcttaagattcaaaggagacttaaagagtgccattgagctttgggaaaatgatattattgattgatttgattttgttttcatatttaagcttgtattctaagacccccgattatttaaatgttcttgatttttttgatactaatgtttttaggtttgattttaacattgaaaatgatgtttttacaattgaaaatgataagggatatttgaagtttagggtaggctttgaatatgcgcttacatcttctggttattatatgtttgtagacccaattattgacattcgtggagaaattttaataagtcaaaaggtattaaaacaaattgaaaattattttagttctcttaaagactataataaacccagaattacttcaataatcattgatcctggacatggcgggcatgatactggtgctgttgtgactttaaagataaatggttatgacgttgtgcttcaggaaaaagattttgcattaacctattctatatatttgtctaaaattttaagtaattattttgtaaataaaaatattttgttaactcgtataaatgatgtttatttaactttaaaagaacggtcggaatttgcaaatgcaataaagccaaatttccccaataatgttatatttttatctatacatgctaatgatgctccaaacggtgaagctagaggagttgagttttggtatcttcctaaggattcaaaaagagaagttattaaagattttaagggatatgatattaaaggtaatagatacttaagcgagcttaatgatatactagatattaaatataaatatgaatcaaaaagattggctgaaattttgtataaagtgtttaaaaatgagttaagcgaaactaatattaggccaatcagaaaagagcaatggtttgtaataaaaaacagcagtatgcctgctgtgttgattgaaatggggtttttatccaatattttagatgctaaattaattttggattataattacatgagcaagtttaatattctaatacttaaagctttaatggaatttataaatttttatgaaaaataatatttcggatatattttttaaatataatgtagtgatttataaatttttaaattcaaaaaaagagcatatgattagggtgcttttggggtctttggcagtaagctttttgttttctatttgtatggtttttttaaattatgataatcttttttcaaaaaaggttttttattttcattctagcaagggatttgttgctaatttaagatatttaagagatgaacaaaatttgaaagataatttagatcttttagtaaaagattttcttttaggaagcaatgaagggttttcttttgggtttttattaagtgattcaagatttttatattcttttttaaagaatggagtttattatgtaaatctttcaagagaattttatgattcttttaataatggtgattataatgaatctaatgaatcttttgatgttaaggtcaatctttttgctatgtctttaataaaaacaatgcgctttaactatcctggtaagataaaaaagattgttattcttgttgaagggtgtatcttaaaggagcaaagttgataaattaaattttactaataaaaataattaaaaaacgaaaattttataaaagatttatatatataaggagttggtttacatgaaaaggaaagctaaaagtattttattttttttattatccactgttctttttgctcaagagactgatggattagcagagggttctaaaagggcagagcctggagaattagttttagattttgccgagcttgcaagagatccaagttcaactagacttgatcttacaaattatgttgattatgtatattcgggcgcttctggtattgttaagccggaagatatggttgtagatcttgggataaataattggagcgttttacttactccttctgcaaggttgcaggcttacgttaaaaattcagttgttgcgcccgctgttgttaagagtgagtcaaaaaggtacgcaggtgatactattttaggggtaagagttttgtttccaagctattctcaatcatctgctatgattatgccaccatttaaaattcctttttattcaggggaaagtggcaatcaatttttaggcaaaggtcttattgataacattaaaaccatgaaagaaattaaggtatctgtttatagtttagggtatgagatagatcttgaggttttatttgaagatatgaatggcatggaatatgcttattctatgggtactttaaagtttaaagggtgggctgatttaatttggtcaaatcctaactatattcctaatatatcatccagaattattaaagacgatgttccaaattatcctcttgcttcaagtaaaatgagatttaaggcttttagagtttcaaagtcacacagttcaaaagagcaaaatttcatcttttatgttaaagatttaagagttctttatgataagttgagtgtttcaatagattctgatattgacagtgagtctgtatttaaagtttatgagactagcggaactgaatcccttcgtaaattaaaggcacacgaaacttttaaaagagttttaaagcttagagaaaaaatttctatgcctgaaggctctttccaaaactttgtagaaaagattgagagtgaaaaacctgaagaatcatctccgaaaaattaggtttaaattaatatgtaaagctacctaaaaggtttgctttacatattaaaataataggaaatagtatatggaaatattagatttggaaaatgaagagcttttaggagttttttttgaagaagctcaaaatcttgtagatatccttgaagagaatattatgtcattagaggatgatcctaataattctgatactattgatgaaatattcagggcagctcatactttaaaaggaagctctgcttctcttgatatgatggagttatctgattttacccatattgtcgaagatgtttttgatgctattagagatggtaaggtaaatataaataatgatcttgttgatctgcttttaagttcattagatgttatcaaggaaatgcttgcgcttcgtattgatggcaaggtttatttaaatgacataagtgatcttaaaagcaaattaaagcaatttttagtaattgatgatcagacttttattaagagatttgatggaaattcaattaaaaacaatttttgtctttcagaatcagatcttgaggagataagagaagggctaggaattggacaaaaggttttaaggatcagtgttgtttttaattcaaatagcaattctgaagttgaaaatagtgggctaaaaatatttaatattttaaaaaatttaggatctgtacttcatacaattcctaaatatgagcaaatcatagaggataaatttttaaaaagggttgattattatctgatatattcagatatagaaggcgtgaaaaaaagtttagattctttaaatttaattgaaagctatttggttgatgaatttaacgtaaaagaagaattaaaaaagcttgcagatgaagagattaaagatgttgatttagattccaattttgttttaaatgataattttgattttacagaggatgagatttctgatttattacttgaggttgaaaatcaaaagttatttaaagttagattggattttgtaaaagacaatcctatggctactattagtgggcttcaaatgcttcaagcattaaaaagtcttggtaaaattttcaagtctatcccagattctagcgaattattggcagataagttttttgattttgtaatatattacttaatatcaaataccagtgaagaaagtattgctaaaaagattaatttaccagatgttgttagtcattttgaaatcaaaaatgttaatttagaatctttaaagagcgtaaggctaaaagaagatgatgaagcaccttttaaggaaaataaaaatattaagaaaaatagtccaattagtgttaatttaattagaatagatagcaaaaaaatagattacatattaaatcttgtcagtgaggctgtaataagtaaatcatcttataatcaaataaattcagaaatgattacattattttataattttaattatttttatgattatcaagaaagttttcagagaaactttttaattgatttaaagatagttttcaaagatgcaggcttaacattagaagatgagatcgaatcacatattaattctttgatgagttttaaaatggaaaaggctcttaaggatatatctgaattgagaaattcttttttcagacttcttcaaaattttaaaatgacctctgggcggctgtcaagaataattacagatttgcatgagagtgttttaaaaaccagaatgttaccaatatctaatatattttcaaggtttacaagagtcgtaagagatctttcaaagaaattaaataagattgtgaatcttaaaatggaaggggaagaaactgagcttgataagtctgttatagatgaccttgtagatcctttgatgcattgtgttagaaattcaatggatcatggccttgaaacagttgaagagagagttaaaaggggaaagagcaaagcaggtactataattttgcgtgccaagaatgaaggtaatgtaatatcaattgagattgaagatgatgggattggtatagatccaaaggtcattaggcgcaaattaattgaaaagggaacaataaaagaagatgcaatttactctgattttgaacttattaacttaatttttgctcctgggttttcaacagcagttcaagtgacagacctttcaggtagaggagttggtcttgacgttgtgaaaaaaagcattgaaaagcttaatggaactattttggtggaatcagaaattggtcttggaacaatttttaaaattaaactaccattgacgttagtgattatacaaggtcttttagtaaagtcggggtctgagacttatgttattcctttaaataatgttcttgaaactcatagaataactgaacatgatataaaattgcttgaaaattatcatgaagtttataatttaagagatgaagtcatttctgttctcaggcttgataaactttttaacataacaagggatgattcattaatagaaaaatttttaatagttgttaatactagcaacatgaagatagcaattgttgtagactctattcttggtgaggaagattttgtagtaaagcctattaaggataaattttcatcaagcgcgggtatagttggggctactacgcttggcaatggtaaggttgtattgataattgatgtttttaaactttttgatttacaaaaggatactaaggagtgatctcttgtgcagataaaagaaatttattttggacccaaaattttagatgataaaaattctaattctaaattgaccaattttgattttaaagttgtttcttttgagcttgggtcggatcattatttagtagacattatgcaggttaaagaaattagaaaatctagtaattttacttatgttccaaatgccaaaaagtatgttgctgggcttgataatttacggggtgaaataattcctattatagatcttagaataatgtttaatttagaatttaataaaaaagatattgaagatattatggttttaaaaaacgaagaccttcttataggggtaattgttgataaaattaataatgttttttcaatagattctagccttattcaagatccacatccagttttatctcaggattctttaataaactatataaaaggcgttgtagattataacgaaaagctttatatacttcttaatgtttttaaaatttttaattatggtgaagaagaaaagttattaaaacctggtcaaaattttgttgaaaaaagcgactttgtaagcgattgtgataatttagatatactagaaaattctaagaatgatttttccaataaggtttcttcaaaaaatgatggtaacaatgaaaattcaactctaaacaatactgcagcttttaatttggaaaatattaaaaaaaatcttttgaaatactcgtttaatgcttctttggtaaatgatgtgtttttggaaaaagttggagtaaaatttaatatggttgatactgattacttgccttgcgatagttttttaaatgaattttattcaaaatcatcgggaaatttgtggggagctgattgtttggaagaatttaaaaatgaaattgttgagagtcgcttaagttttatgaataacttaaattctattttcaatgtattggaaattggttgtggtagtggaaaggagactatggctttagccaatgctttgtctgaatattatgtaaaaccttttaagttgacggccattgataatgatttatcaaaagttgttgaaacttctaggttggtgttttcagagtcagaaattggcattagtgaaatttatagtaggaattcttttgaacaaagtcccggagtttataaatttaagtcagaaatcctaagtaatgttttgtttgaatattccgatgctcttttttcagatttgcctgataatttgggaatggtttttttaaaagatgttttatgtttcttggatagtaaagatcagattttaattttaaatatcattgcttccaaagctattaaaggggctcttttggttttgggagataacgaagagcttaaaaataatgatgtttttataaaagagaaatccacaaaatattttaacttgtacaggaaagtctaaaggagaaattaatgagaatagattatatagagccatttttggatgctgcttcttcggttttaagagatatgttgcttgttgagaatatagaaatgggtaagcccgggcttaagtcgataaatcaaaagataaaaggtgtttctgtaatagtagggcttgctgggtctgttgagggcagtataattattgatatggacatagaaacagctctttttgttgcttctaaattaaattttgaagagtatgatgattttgacgatgaagaaacaaaagagatggttgctgcaactctaactgaggttggcaatattattgctggaaattttgttaccactttgcatgccaagggttttgtatttgatataacccccccagcttttatttatggagaaaatatgaaaataagtaataaaggttctgaggctttaattgttcctttttctttgcctgatggtaaaattatagaagttaatattgcaataagagagagggtttgatatgaaaaaaattctttttattagaagagagaggttaatatgattcaaaagactacaattgctgcagattcttcatctaagcctagaggaatcaattatgatacaggcattccttttaatgttttaattgttgatgactctgtttttaccgtaaagcagcttactcaaatttttacatcagagggctttaatattattgatacggcagctgatggagaagaggctgtgataaaatacaagaatcattatcctaatattgatattgtcactcttgatattactatgcccaaaatggatggaataacttgtctttctaatattatggaatttgataaaaatgctagagtgataatgatatctgctttaggcaaggaacaattagttaaggattgcttaataaaaggagcaaaaacatttattgttaaaccattagatagggcaaaggttcttcaaagagtaatgtctgtatttgttaaataaattatttataaaaaaagttcaagctttaattttattattttcattcccttgggaaaaaaatcatttcattacttattttatctaaattctttaaaaaataagtaatgttaaggttaaatatttttagaggttctgcattattttctatgtaaagttctaatttgtaaaatcctttttttgtatatattagtgaatggcttttaaaaattccatttatatttttgattttaaatattttatattttaaaaattttttatcaatgagttcgctttgaattagatatttatttgcttctttgtagtttgaatttaataagctgtagttagttttattgagcattatgctttttacaaaatgttctgttagtttataaatatttttttctatttcgcttgttggaaaattggtatagtattctttttctaaaattaaattataagacgaatatttttttatttcttcatctgctcttttttcaattgaaatgtccaaaagtctggcattaagtggaaaatctaacaatgcaagcagcattataattatttgaattttcattttatttcctggtttttattaattattttttttactttttcaatttctaaaggtattttgctttttcgctttgagtttagtttttcttttagcaagagattgttaaatgattttgcaagttcatatactttttcttcgcttaaagtaaaaggaatttgaatttttcgatattctaatgggtcttgtaaaatttttgtcattaaaataataggatttaaaaagcttgctttaaaaaatttataaaaattcattaaaaaaatagtaaatgatgcaaacaatgtaaatagaaaaattccaagaatagaatcgctttttctttgcaaatatttatctatataaaattttgttttctccatttctattactctatattcactgggactgtagtaaacaaatatttcgtctgattttgagtatattatgtcatctttttccttgattattaagatgaagggatatttttctttaatgtaagctttttcatttattattgatatatttttaatgatattaaattcttgtttttctggtattgaatttacaatttttgagcttgatattattataaaaaatgtaaatggtattaataagctcattgaaaatgtcctagcaaatgctattagtattaggttcttttcttttgaattgtaatatatttctattattaggtcattaaacctaagaagtcttaaaaatcttaacttgaaaagtgatagcattattggatttaatattgtttcatgggcgacaattatgtttttaagctgatatgagctataaaacgctaaaggaataaggcagtggattatatcgaagaatagattgtttctgacgtagatttctaatctttgggaaaggtaggccttggttattttgtataaaaaaatgaaaataaaaattgtgtcaaatagaaacccaagaaatattagtgcaaatcgtattttgtatggtaaaaaaagaattattgagagttcttcgattaaaagttcaaatattgaaaaaattattattgcttttaagaaaattgaaaatttttttaccatttatttaccttggctatttctgataattctttaattattcttgaatcatattctctagagcccgactgttttattgaaaaccaactttcatcatacccaataaaacctttaaccggattgtttttgtattttggagttcttgctctggctgaaaaaatggcaattaatgttgaaattggagacattgtttgtaaggtctcatatttgaaaaagctttcaattataagcttagctgtcttttcgtctagaaagtcggtatcattgcttattgcttttgaagtggattcaatgtttttagtagtaagctctattcctttttcaaagcagtatttaattaccaatacttttaagagaagtagtatctttatataattttttatgatgtctgatgaataaagtgctttattttccttttgtattaagtatattgtataagagttttttccttcaaatagtttgtttatataaaaagtaatgtatccattgcttatggtattaaaattataaaagaattcttttcttaaagatgagttgactttgacaaagttaaatatcaaatttaagtcgttttttgtcaattctttactaaaaagaggctttacaatgttaaaatcaatagcttcaatgccagataaaacaaatggggtaatcattatatctgttttatccttgacgtattgaattaggtcttttatttctgattcaaaatcatttttgataaatgtagcaattgtttttttgttttcttttaaatagttgagtatttcaatttctttttctatggcagataaactttttatactttcatgattgaatagataatgatataaataaggaaaatatggttttgtattcattttattaggtccaatagttcaagtggattgtgtattatatgttttgctccactttcttttaattcttgaacacttctaaatccccaagaaacccctattggcataaatccagcgtttagtgcggttagcatatccacatcgctgtctccaatatatgcaatttcttctttttgggcatttaattctaatatcatatcaagggcattttcaggatctggctttggtggaaaattttttgaataacccctgatttcaaaaaacaatatatttccaaaaatatttttcaccaaatttattaattcttcgtggttcttattgcttaaaattccaattggaatgttaagcttattcatagtttctaaaaggggttttatattttcatatggttttgtttggaatgaaaggtttttattgtattctttaacaaattctttgtaaagtttttcttgtaaattaggattatcatgttcaagagataatagctttagagtgtctattacaaacttgttaaatcctctgccaacaagggcattgaatttgcttagttctattttactgtatcctaagtttgaaagagcagaattcattgagaatgcaatatccattatactatttaccagtgttccatccatatcaaaaatgcaggctttgattttcataatactctcttttgtaataatttatttattcttttattttaacattaatttgctctctttattaaggtttttatattttaagcatttttatttattagcaattaatttttatagataatttattttgtttattaaaatttaaaatgctattgaaaatataaattttaagctttattatatttcattagaatagaatattgtaagtcatttatgtttgatatttatattaggattaaagcttgatgaaagaagatgtactagtattagaaaatattacaaaaaagtatggtgattttgttgccaatgataatgtttctattaaatttaaggcaggcgaagttcatgctattcttggagaaaatggtgctggaaagactaccttaatgaaaactatttatgggattcatcaagtaaatagtggtcgaattattttaaaaggtcaagaaataaactttaaggattcaagcgaagctattcgaaatgggattggaatggttttccaacactttatgttaattccgcaatttactgctgttcaaaacattattttgggatatgaaaattcaaaatttggttttcttgattacaaacaagctagaaaaaagataagttctctttcggaaaagtatggtttaaagatagatttagaaaaaagggttgaagacttgagtgttggcatggaacaaaaaatagagatattgaaagttctttatcgaaatgcagatattattatttttgatgaacctacagcagtgcttgctccaagtgaagttgatgattttataaatattttaaaggtactcgcccaagagggtcatactgtaatacttattacccataaaataaaagaaattagatctattgcaaagaaatgtacaattatgcgtcttgggaaggttgtaaaaactgttaatattgctgatattgatgacaaagatcttacaaaattaatgataggaaaagaagttgcacttcgctcatctaaaattaaatttgaaaatcattttaatattcttgaaataaagaatttaagtgttaaagatgagagaggagttttaaaagttaaagacgttaatcttgatctgagaaatggagaaattcttggaatatcaggtattgaggggagtggtcaggaggatttagttgatgcaattttgggtttgaaaagcatatttaagggcgatattttgaaaaaaaattcttcggggaatttggaatctttaaaaggtttaactattaaacaaagaatagataaaaaaattggcaatattccttcggacaggcaaaaacacggccttattttagaattcaatgttatgcaaaatattggacttaagagctttgataatcctgattatttgagattaaaaacaattcatttgaagagtaattttgatttaaaattcaattttttcaattttattaaaagacaattcaataagtttaaaaaacaatttgtggggtttgatcttaatattttaagaaaattgagcaatcaacttgtaagtcattttgatattagaccaagagatattttaagcaaggtaaagcatttatccggaggtaatcaacaaaaagttattgttgctcgtgagattagtttagagccagatattcttttggctattcagcctacaagaggccttgatgttggagctgttgagaatatttacaaaagaataatagagcaaagagatgcgggtagatctgttttattggtttctcttgaacttgatgagcttgttaatgtttgtgacaggatagctgtaatgcatggtggaagaatagtgggcattttagaggataattttgatattgatgttattggtaaaatgatgataggcttaagctaaatgacaattagtaaaaacgtatttagtaaatttattttgaaatttttaaattcttcagcatttgttagtgtatttgctctatttgttggatttttaattgttgggctagtggtgatggggcttggtcattctccttttagaatgtattttataatattagaaattattttttcttctcccaaacatttaggttatgttttaagttattcagctcctttgatttttacaggtctttctattggtatttctttaaaagcgggtctttttaatattggggttgaaggccagtttatactaggatctattgttgctttaatagcatcagttttacttgatttgcctccaattttacatgtaattactatttttattattacttttttagcttcaggcagtttaggaattttaatcggatatttaaaagccaaattcaatattagcgaagtgatttcaggaataatgtttaattggatattatttcatttaaataatataattttagattttagttttattaaaagagataatagtgatttttcaaaacccattaaagaaagcgcatatattgattttttagcttcttggaagctctcaccagaaggtcttgcttatagatcttctcatccttttgttaatgagcttttaaaagcacctcttcattttggaataattttaggtataatttttgctattttaatatggtttttacttaataaaactattattggatttaaaataaatgccacaggaagtaatattgaagcttcaagatgtatgggtattaatgtaaaagctgtgctaattttttcaatgtttctctcagcagctgttgcaggtcttgctggtgctattcaacttatgggtgttaataaagctatatttaagctttcttatatgcaaggaattggttttaatgggatagctgcttctcttatgggaaacaattcgccaattggcataatattttctagcattcttttttctatattgctttatggaagcagtagagttcaaagtttaatgggccttccatcttcaattgtatctttgatgatgggaataattgttcttgtaatttctgctagctattttttaaataaaattgttttaaaaggtgttaagcgtgtcaaatataataatattcttgattagtgaaactttaataaattctcaaaccttaattttagctggtcttgggggtcttataagcgagaaaagtggaattattaatattggacttgaaggaataatgacaataggagcattttcaggagctacagttgcatattttacaaatgatccattgttttcaatttttgctggtgggctagcagggcttgttcttgctattttgcacgctgtttttacaatttttttaaaatcagatcaaattataaccggaatggcacttaattttttaggacccgctattgctgtttttataagcactttgattttttcttctatttcaactccgcctatagaaataaagttgccgatactttttgatggaattttaaacaaaacatcttttatttttcaaatttttggcaaaagatattctgtatacattgcaatcctaagtgtggttttgtttcatattgttttcaaatacactaaaattgggcttagaattaatgcaagtggtgaaaatccagaggtattagagtctgttggagttagtgtaaataaaattagatttttttgcgttcttttgagtggttttttagcaggggtttcaggtgctgttcttacaacggtggttgcatcaagttatgtgcaaggggttacaggtggacaaggttttattgctattgtaatgttgatttttggaaaatggacgcctttgggagttttaataggcagttttttgttttcatttgtgaaaactttggcaattgttttggctcaattaccctttttttctttaataatgcctcccaaaatgttagtgattaccccatatttaattattattctaagtcttatctttttttcaaaaaaaaattatgcgcctaagttcttaggaataacctataaaaagcattagcagttaataataatagtttataatttgtttttcatgttgtgaaaattcttttatttttttgagagtttttgattttttgctgtaaatttttttttgataccctttggtcttgagtttatttgattaaataagtaggtgatttgtgaggtagtttattatgttattgaagcttaaatacaggtttgttggatttttattattgtttttaatttttatactgctacttttttccacgatttttaattttgttttatgcggttatttagaagattattataagcagcttacaagggcgcaagtaagaagagcagctttttctttgcaatcttttttagacaccctgcatgtcataatcaatggtgcagcttctaatttggcacttgaaaccatatcagaatttgcaatgtctgagaatagaggaaaagatttctctgagtcggaattgatagatttaagaaaaaatccaaaatttgttattgactctgtaaaggtgagcaaaaaatatcgacaatacttatacaattttatggccaatcttaaaaatgataccctttttgaagaattcgctttttttgattttgaagggagagtaattgttagcacaagacatgagaataatatggattttggtcattctgaggctaataccaattattttaaaaaagctgttgaggattataggcaaaaccaattaaaatttataggttggtattcaaatctttctgaaggaatatccgcagaagttgctattaggtctaaacaaagcgaaaaaaaggcttttgcaataattgtacctgtatattccccagaagataaacttgtttgtgggtatttggccggatatttgcttaatgatattgtggcagatagttttgatagatttagattcggtttttataaaagaggcaattttatttatgtggatcccaacaatatagcagttaatccttttgaagaatataatgaaaccagcagggttagttctaaatttttgaatgttcttaaagatgttttctctaagcccccttttccatcaaacattgccagtgaagtgtcggtttacactattgatagaatacttttgtccgaaatgggagaagattgttattatgcaatgttgcccataagtagtaaattgggagaaaagagtggagtacttattgctaggcttccttataaggatatttacggagtaatatctagtctaagatttcagtatattttatattcagtcttaggcattatagcattaagtattgttctttcaattagaatagacaggattattagttttcgtttaaacgcaattagagttctagttcaagatatggttaagggcaatttagataaagattatgctcttgatgatgatgaaaatactcttgatgaacttggcatgttaagtcttcaggttgttaaaatgaaaaaagctatttctgtagcaatttctagtgttttgagaaatattagctatgtaaataaggcaagtttagaagttgccagttcaagtcaaaatttaagctctagtgcattgcaacaggcatctgctcttgaagaaatgtcagctaatgttgagcaaatagcctcaggtgtcaacatgagcgccaataattcttatgaaacagaacaaatagctttaaagacgaatgaaaattctcagataggtggtagggccgttgaagaatctgttattgctatgcaagacattgtggagaaagttagtgttattgaagagatagctagaaaaaccaatttacttgctttgaatgcggctattgaagctgcaagagcaggagatgagggaaagggatttgctgttgtggccagtgagattagaaagttggctgatttgagtaaaatttctgctcttgagattggagagttagttgaagataactctaaggtagcaactgaagcgggagtgatctttaaagaaatgctacccgaaattgaagaaacggctaatcttgttaagaagatttcagaaggtagctctaagcaaagcgatcagattgctcaatttaaaatggctttagatcaggttggagaagttgttcaatcttcagcttcaagcagtgagcagctttctagtatgtccgataaaatgttagaaaagtctaaggaacttagaaaatctgtattatttttcaaaattaaagattctaaaattgaaaatccagaaaatgatgattatgatttcaggttaatagattgtcctgaaaattcttttaaagatgaaaatcaaaatttgaaaagcaatggaatttctacttcaaatgccagtgggcataataattattctttagatattgagagcgaatcttctgtaagaactattaataagcgagttgatcctaaaaaagctatcgatattgctgataaggatttaaattttgatgatgatttttcagagttttagaatttattttttgtaaaagaggtggttagtatgaagcttaaagctaggatgttgctacttgttcttattctgatagcattctttatatcaattttgttttttgcttttggaatgcttattaatagtaaattggtggatcaacagtttaatcttatgataaatcttattgaaagcattaaaagttcttttaatctttacatctcttcaatggaagagaaagttagggttagttccatgtatttcaactctgctgaaaaatttaatgaggctagtaaaattaaatccaaaaggttgagctttatttcagatcaatctgaaattcttattcaaaccggtagtaatatgatggttacagacaaagaaggtaaaatagtgtttactacggcggttaaggataatagtgattttggcaaatctattggggatagagaatattttacaaaacttaaggagtctaatagtattgtttacaattcctttgtcatgttggcagatcccgggtctattgaggagtctttacttaaagatatttccaagataaaaaataaaaaaggtcagattccttacatattaataggtatgccattaagagattttgaaacagataacatttttggttattttatgtttctttattcaatggattatatatataggtcttttagagggattaattttggaatactctctagcggtcgtgcgctagcttatgatactacgggtagattgttggttcatcatgtagtattgccaggtgatattttgactgatattagtgcttcttattccaatattattaagaaaacatctgaagatttgttgcaaaagaataaagaaatttcaactgtttattattatgatcctaaaagcaataagaaatatgtgggaattagtcaaaaggtgttattaaacttgtctaataataaatttattcttttaatgagaacttcagaggacgatttttattacatgtcacgagctacaactataatcttagcaattagttttgtatttacattacttatgcttgctattgcaactctttatcttgtgaaaaagttaagctcttctttgaataagatactggaatattctgagagacttgcttctggtaattttactgctgatattaattttggcaaatgggatactgtagagctttacagtttgtacgaagggcttgagcagttgagaaccaatttttcttcagttgcaaaaggagttattgaaaatctagattatctttatgaaaatgcaattcaaatagcaaatgcaagccagaatttaagttctggcgctgttgagcaggcttctactttagagcaaatgacagcaaatattgagcaaatttcacaaggtgtttctgagaatactgaaaatgcagctactactgaaaaaattgctgttaatactaatgaaaggactaaagaggggcataaatctgttgttaaggctattgaggcaatgactgtaattactgaaaaaattggaattattgatgagataacaaggcaaaccaatttgcttgctttaaatgcctcgattgaagctgcacgagtgggagaaaagggcaagggatttgaagtggtagctgctgaggttagaaagcttgcagatcaaagcaaagaatcagcaagagagattattgatattgcaaacagaagtttaactgttgcaagtcgtgctggggaaaattttgaacaaatagttcctggtatggaacaaacagccagacttgtaaaaaatatttctaatgaaagttataagcaaagtgttcaaatagagcaatttaaaaatgcaatagagcaggttagtcagttagtccaaactacagcctcaagcagtgaagagctttctgcaatgtctgaaaagatgttagagagtgtaaaagatttaaaagaatctgttgattattttaagatcgaaaagtaagtagaagattgaaaaatcttctctaactttttgggcggattattattctatgattttaaaaattttagcaccccccaggcattctgtgtttttataaaaaattgcaaattgtcctggggagattccttgatcttttttgtttaaagaaatttccattaagttatttgtaataagttttaatttgcatgagtatttcttttcgccatgtcttattttaattttgaaattttcaaagttcgtaggtgtgtcgtttatccaatgtatttcgtgaactaaaaatttgcgttttgcttgttttaaataattctcgttatgggatatgtatataatatttttttccagatctttttctatgacgaaccatggcccgttgctaagttttattcctcttctttgtccaactgtaaaaaaccaatatccgttgtgaattcctattatttttcccgtttctttttcaattatatttccctttttctctccaagatggtatttgataaattcgttatatttaatttttcctaaaaagcaaataccctgactatcttttctatctttgttgggtaaatttatgtttttagctatttgtcttacttcgcttttaagtaatgtgcctaagggaaagtatagttttgacatttgtttttgagagagatgagataaaaagtagctttggtctttaattttatcttttgcctgttttaataaaaatttactttcttttatttgtattttagcgtaatgtcccgttacaaccaaatcatattggctattgattttctcaaaaaatgctccaaactttatcctttgattgcaaaaaatatctggacttggggtattgccatttttaagttcttcaatagtatagcttactactttgttataatattctttttgaaagtttattatttcatacggtacattaaatttgttgcatatagcttcaacataatttaaatcttcttgccaagggcagtttccaatataagacagttcatcttcaacccagatttttaaatagtagcattttatatttgaatatcctttgtttataattctataaagggcaacagaactgtcgactcctccagataaaagcacggctattttcataaacttccatttttaggttttattatataagattttgctaatttttgtaaattataatataatacttaaggccattaattcattgaggagtatatgagaataggtattagtgatattagaatttttttacctttaaattatttagatttttctgttcttttggaaaatcctttatatttttctaatgaagttttttttaaaaaaatcaatagagcaatagatgcaaccttgcaaaaaggttttaggtttaccagtcctaatgaggatagtgtaaccatggcaagttcggctgttaagcttatttttgacaacaataatcttgatttaagcaaaattagaatacttttgggtggaactgaaacaggcgttgatcattcaaaggccatttcttcttatgtttttggagccttaaagcaatctggtatttgtctgggaaataattttctaactttccaggttcaacatgcgtgtgctggtgctgctatgtctttgcacactgtggcaagtgttttaagccattccaataattctgaatacggcatagttttttcttcagatattgcacattatagcaatcttactacggctgagattacccaaggagccggcgcaactgcaattttgattgaaaaaaatccaaagctactttcgatcaatttatctgaatttggagtttatactgatgatgttgacgatttttttaggccttttggaagtgttgaggctaaggtgcgaggtcagtattcagttgaatgttacaataatgcaaacgaaaatgctttaagagattttgctttcaaaaagcaacttagtatgaaagatttattttctaattataggtttgttttgcatgttccttttgctaaaatgccaatagattcaatgcattatattttgaaaaaatattatagcgatgacgaatctgttagaaatgcttatttagaatcaatagatttttacgatggagttgaagctgctatggaagtgggaaatttgtatacaggttcaatttttctatctttagcattttatttaaaaagagtattttccaagaaagatattacaggggaaaagatattgttttgctcttatggatctggcaatattatgattatttatgaacttaccatcgaaaagagtgcttttgatgttattaaattatgggatcttgaaggtcttataaaaaatagaaataatgcaaattttgaagaatataaagatttttttcaaaataaaataattcctggtgaatccagaggattttatttaaaagaactaaggaatgatggataccgagtttatgggtatcgagcctaatatattagaaaataaaaaaaggcatattgagatttgtttaaataaaaacgatgttaaaggtggctgtaatttcttaaagtttattaagctaaaacacaatgctcttagtgattttaatttttccgagataaacataaaagaagagatatttggatacaatattagtatgcctgtttttatttcttccatgacagggggcagtaaagaggggaatgactttaataaatctttagttagaattgcaaattatttaaaaattcctatagggctaggttcttttaagcttttgtttaagtatcccgagtacataagagactttactcttaaaaggtatgctcataatattcctttgtttgccaatgttggtgctgttcagattgttgaatttggtatttctaaaatagctgaaatgattaaaagattagaagttgatgcaattattgttcatcttaatgcaggacaagaattgatgaaggttgatggagatagaaattttaaaggaataagagagtcaatagccaaattgtcagactttttaagtgttccattgattgttaaagagacaggttttggaatttcgccaaaagacgttaaggaattgttcagccttggtgcttcttatgttgatcttgcagggagtggtggaactaattggattttagtagaaggcatgaagagtaataatctaaacattgcatcttgtttttctgattggggtataccttcggtttttactttacttagtattgatgattctctaaaggctaatatttttgcatctggtggatatgagacgggcatggatattgctaaaggcattgcccttggagccaggcttataggtgttgcagcagttgttcttagggctttttatgattcaggagaagatgctgtatttggtcttttttctgattatgaacatattttaaaaatgtctatgtttttaagtggaagcaaaagtttattagagtttagaaataataagtattttttaagtagttatttgcttgatgaacttggagtctttaagcagttttatggaacttagtaaaaattttagacataaaagcgttttagaaaaaaggcaagagataaaaagttttttggaattatcttataaagattttttttataataatgccaatgaagattttctttttaatatgatagaaaattatattggatatttatcttttcctattggaattgtaaaaaatttgaaaataaatggcaaatactattctttgccaattgcaacagaagaatcttctgttgttgctgccctaaattttgcggcaaagattcttgaaaatgctgatttaaggtattctttgggtgaagtgttgggaatttcgcaaatttatataaaatcggaaaaagatttaagtaaaatttttgttgaccttggtgataaaattaagacttggattgaacctcttttaaccaatatgaatcaaagggggggtggatttagaaggttgtcaactaggcacattaaagaattaggtattcaaaaattaaatatttatgtggatacttgtgatgctatgggtgctaatttgctaaactcaattgcagagcgtgtagcagaatttatttttttagaattcggatatgagtgtgttttaaaagttttaagcaatgatattagtgaatttacagccaaagcccgttttgttttagattttaagcatttgctaccgggtaaagaggattcttggaatttggctaaaaaaattgaacttatttctagtataggtttttacgaagaggagcgagctgttactaataataaaggtattatgaatggaattacaggggtgtgtcttgcaacttttaatgacacaagagctcttgaggcctctgttcataaatttgcttcaaaaagcggcaaatattttccccttagtaaattttatactactgacaatgctttagttggagaaattgaaattcctttgcaagttggaactaaaggtggggttatatcttttaatgaagcttcaattttaagttttaaaattatgaatgtaaatagtaagagcgaatttattggtattctctcttgtgttggacttgctagtaattttgcagcattaagggctcttgcatttaatgggattcaaaagggtcatatgagattgcatgttaataaaatactccatcttttaaagacaaaatataatatttctgattttgaaaaagacaaattattattggaaatggaaagaatgaatatttattcttttgattttgcttttaaaattttgaagaaaataaggttagagaatgaaaataaagtgtaaagttcatgcaagcttagctttaattaaatattgggggaaaaaggatgtttttttaaacattccagctacttccagtcttgctgttagtgttgacaagttttattcaataagtgagcttgaactttcaaatcgagatgaaataattttaaattcaaagccagttatattaaaaaatagagaaaaggtgttttttgattatgcaagaaaaattcttaatgaaccaaatgttagatttaaaattaaaagtaaaaacaatttcccgacagcagcaggccttgcaagttcaagttcaggttttgcttctattgctgcttgtattttgaaatattttaataaatattcttgtaatagcgcatctaatcttgcaagagtaggatcggcttctgcggcaagggctatttacggggggtttactattttaaaagagggttcaaaagaatcttttcaattaagagatcaatcttattttaatgatttgcgaataatatttgccataattgatagtaatgaaaaagaattgtcttcaagagccgcaatgaatatttgcaaacggcataaattttattatgatgcttggattgcctctagtaaaaagatttttaaagacgctttatatttttttttaaaaaaagattttatacattttggagcaactattgtaaaaagttatcagaatatgtttgccttaatgtttgcatcttctattttttattttaaaaatagtacaatagatttaattaggtatgctgctgatttgagaaatgaggggatttttgtatttgagacgatggatgcaggcccccaagtaaagtttctttgtttggaggaaaatttaaatactattttaaaaggacttaagcaaaattttactggcattgattttattgtttcaaaggttgggtgtgacttagaatggatttgattagtttttctgtacccggaaatttacttttaatgggggagtatactattttagaggaaaagggattggggttggcaattgccatcaacaagagagcatttttttcttttaaaaagagcgattcttggcgcttttttagtaaaaagaaaaaaatagacgatttttctttaatagaaaatagaagcgattttgtttttaaaatgtttgcttacttgagtcaaaattgtttttttaatctagagaattttgcgtatgatgtatatattgatacaagtaattttttctttaatgatggaactaaaaagggatttggttcaagtgctgtcgttgctattggcatagtgtgtgggctttttttaattcacaatgctaccaatgttgttgagaaaggtgaaatttttaaatattgtttggaagcttacaggtattctcaaggaggaataggcagtggatatgatattgctactagtatttttgggggtgttattgagtttgaaggcggctttaatcctaaatgcaggcagctgggtgctgtagagtttaatgatttttatttgatgcagggtttgcaagcaattaaaactactacgtctatttgtgaatacaataaacatagaaattctattttagattttatattgaaatgcaatttggagatgaaaaagcttgttttaaatgctagcaattccaaatccgcattaatttctagtttaagaagggctaaagaattgggattggcaattggagaggcaataggagtttcggcagctttgccttcaagttttgatcaccttttaggtcaatgtgatttgattaaagctttgggagccggaaacgaaacttttttagtttacaggcccaatattgaagcttttaatttgtcaaaaattatttcaattgttttagagaatgaaggcattaagtttgaaagcgataaatgctaagaataagaaagcctgctaaaatattgttcttaggcgaacatagcgctgtttatgggttcccagttattggcgctacagttccaatttatatggatctgatttatagtgtatctaaaaattggaaatatttaggaaaacccagtacaagattaaatagccttataagttttattgtttcaaattatagcaaagttaatcctattgagtttgatataatttctgaaattcctattggagttggtcttggttcttctgctagtcttagtttatgctttgcagaatatattacaagtcattttgaatataaggattgtaataaaattttgttggcaaatcaaattgaaaacatttttcatggcaaatcttctggaatggatattagactaatcgatcttaatggaactttttatttagagaaaaaagaaaatgttttacattcaaagaaaataaaagattctggtttttattttctaataggagcaataaaaagagatttaacaactaaagaaatagttgttaatttgaaaaaagatctattatcaaatgcttatttatttgtttttattgaaaagcttggccttgccgtaagcaattcttatgcttcttttcagaataaggatgtgtattctttagctaatgaaatgaatattgcacaatgttgtttaaagcgtttggggttgtctaatgatactcttgattggctgataagtgagggaatcaaattgggcgctctttctggtaagttaagtggcgctggtaaaggaggagcatttatttttctttttgaaagcctaataaaagctaatatagtgcaaaaagaattaaataacatgcttaaagattctaaaatagatttgcttttaaagctaaaggtaattgagacttagattatttttgggcccagagagattcgaactcccgacatcctgcttgtaaggcaggcgctctgaccaactgagctatgagcccttttattactaataagtagtatacagtataagctttaatggtgtcaattcttatattttctttttccaaaaagaactacaaatatatctatattgtcagtcgtttttaatctatagccacctattttatcggtatctgtattaataagagcttctttgtggcttggactattaagccatgcattaactactctgttaagttcaattcctgatgccagtatttctcttgttaaattaaaggattgatcgtatttatgtattctttgcattggggttgtgccaaaaagggtgtgagttattgttctattttctcccagtttaatggcatattcttttgcaactttttcaagggtatcatctatttctagatggtttagatttaatttttttctcaattcagcaatttctgaatatagaattttcatatcttcttttgtatctattttatgcattgtacttaaattgcatgcttgagataaaaacagtgtaaaaattataatcaattttttcattaaatatcctttttatttattatggtattaaaaccataattatatctcattatgtattataataattatataaaggagatagttatggaaaagtatttaagctatataaaaaaggatgatttagacgcaatacaattaaaattacaagaattgttagcaagtttgcatattttttattctaatttaagaggtattcattggaatataaaagataccaatttctttgttattcacaaaaaaactcaaaaactttatgaatatattgaaaaaattattgatattgttgcagaacgctcaagaatgcttggatatgattctgaatttagatattctgagtttatgaaaaaatcctttattaaggagcttgatattgaatcaacttctaattttttgccctcaatggaaagcattgtttgcagtcttactgagattttgaagaatatttttggaatgagaaaattaattgatactgctggtgattatggtactgctaatattatggatgatatcatgagtgatcttgagaaacatttatggatgcataaggcattgcttgaaaattgcgattgtttttgtcacgatgagaatgaaagcaaatgttgcgagtgtgatgcaaaatagcaattttattaaaaggtttaacctgtgctaatgaatttatctgcattgaggctgtggtagttgttggggatttatgagtattagaaatattggaattatggctcatattgacgctggaaaaactactaccacagaaagaattatttattatactggcaaaagtcataaaatgggggatgtagattcaggaaacactattactgactggatgcctcaagagcaagaaagaggaattactattagttcagctgccattacttgtcattggaaggattgccaaataaacattattgatactcctgggcatgtggattttacagcagaagttgaaagatctcttcgagttcttgatgggggtattgttatttttagcgctgttgatggaattcaggcccaaacagaaactgtatggaaacaggcagaaaaatacgaaatcccacgacttgcttatgttaataagatggatagaataggtgctgatttttttaaagttgtgggagatattgaaaataaatttaaaactattcctttggttttgcaaattccaattggaaatgaaagcaattttgaaggagtagttgatattattttaaataaagagcttcatttttcaatggaaaatggaattccaaaattaacttatagtcaaattagagaagaatttattgaaaaagtgattctttttaaaaaaaaattaatagacattcttagccaatttagtgaagaaattactcaattatttcttgaagacaaagagattggtttagatattattaaaagagagattagaagaggcactatttctagatttattattcctgttttaatgggaactagtttaaaaaatattggaatagaacctttgattgattcgattgtagattacttgccaagtccttttgaaaaaagttttagcgctttttctttagacacaaataaaaaaattttagttgatcctaatgaaaataaaaaattgtcagcccttgtttttaaagttcaatattcaagcgtgattgcttctcatctttattttgttagagtttattctggcgagattaatcctaataaaaaaattatcaatgcttcaaatggtaagcgtgaaaagtttacaaaaatttttagagttttttcaaataaaaatgaacaaatagattttgtaaaaacaggcgatattggtgctgttttgggattaaagttttctgttacaggagatactcttgttgaagagaataataatgttttacttgaggctgttatgtttccagagccggttgttttaatgtctgttgagcctgaaagatcatcagatgaggttaggcttaaggaaatttttgaaataatatctaaagaagatcctacctttagttattctgagagtaaagaaacagggcaattaattatatctggaatgggtgaattacatcttgagattattttaacaagaattaaagatgaatttaatcttaatgtttatacaggaaagcctcaagtaagttacagagaaagtgctggcaaaattgtaaaagaagtttttgagtttaacaatatttttgctggcaaaaatattgattttaaaattggaatgatcattaaacctttgtcgcggggtgcgggaaataaaattgattttgaatgtggcattgaacctgtaattaagtctgcaatattgaggggaattacatctgcatttgtaagtggaatttttggatatcccattattgatattaatgttagtattttttctattgtttgtggggccaataagattagcgagagtgcttttgagtcaatttcaggatttgcttttcatagtatttttcaaaaatcagatcctattagacttgagccaataatgttattagaaattagaacacccattgagcatacaggcgaaattatttctacattaaatgttatggggggtgttattcattcagttagcaatattggagagtatgacttgataaaatcagaggcggcgtttgagaaactttttgggtatgcttctattttgagaagttctactaaaggaaggggcagttttactatggaattttcttattttaaggaaaaattaagttaaagttagtggtttttaaggcaaaatggcttttcttgtatttattatttttaaatccaattaattttattgatgagtttttatgtaaaaatgattttattcccttttttgttaagctttaagtttttgatattttatgaatgtgatattatgatgtaaaatgttttttagccttataaaggcatgtttgtcttttaagaatagataaaatattgtattggtttttttgatatgatattttataatattttttttattttaaaaataaaggaggtgtattatgcagggtgaaaatatggtttcaattagaggcggaaatagaagaaaaattcttcttagtttgaaaaatatgcaatattcaagaacagacctggctcgtaagttaagcttgacaaatgctgcagttactattttgactaatcaaatgataaaagaaaatcttttgattgaagttggctctagggtgtctgatgttaaaaaacatggacgaaaagaaatacttctcgatattaataaagattatgcgtattcaatgggagttattatttctagcaattattttcaaataggtattgccaatcttaaatgcgaggttttaataagcgagactcattcttttgagcccccagttagcgcttatgatattttagaaaaaataaaagatcatatgatagaaattatttggaaacataatttctcaagagataagtttattggcttaggctttagtattacagggttaataaaggataaagaattgggcattgttaatgatagctatggatcgtggattgaaaaagatgttcctgttaagagaatacttgaggaatacttttcactaacagtttatcttgaaagttatgttaaaaatttatctcttgctgaatttatgggtaaaaatatagataatattatgttttttgactacacagatactgctgaactttcgatttggtcaggcggcaatgtttaccctggttttaataataaatcaggtatggttagtcacatgataattgattatgagggagaaaaaaattgtccaacttgtggtaataagggttgtgtcaatatgctaatatctaattttgctttgcagagattgatttccaaagaatttatgaatggtgagattcctgagctttatgaaaagtatgagggcagattgaaaaaggttacaatatatgacattttttctctttatgaaaaatatgattttataaataaaattatgcaagatactgttaaatatttggcaataattattattaatattcaaagaatgcttgattttaattatttagtactctatggtcaaagttttaaattaaaagctttttttgatttgttaaaagaagagattaaaaagctcaataaagagaatatagtattaaagcttagttcattagatactgaagtttctgttgttgggcccgcttccagtgttatttttaataaattttatttgactggaggagatattgattaatattgcctttttttgtatcttatatttgacaagattatttttgagaataagggttgtttttaatgcttgaaagtttggggtcaaattttagaaattttataaactatctttctggaaaatctacgataaatgataaaaacattgcagaggctattgagattattaaaaattctttagttgatgctgatgttaacttaagagttataaggcgttttttaaattctataattgaagaatccaagggagtaaaagttttaaggggcattgatcctaaatctcagtttattaaaattgtcaatgataatcttgttaaatttttgggaggcaaaaattatgagcttagtttacatcctgccaataagcaatcttatattcttatgttgggacttcaaggttctggcaagaccacgacatgcgccaagctttctttaaagcttaaaaaggaaaatagaaaagtacttcttgtagctgctgatacttttagagcggcggccgtagaacagttaaaaatattgggtggtcaagtaggtgttccagtattttcaattgaaggggaaaaagatcctattaaaattgttaaagcgtctatgaagtttgctgaatctaatttttttgattctgtaatagttgatactagaggacgacttgaaattgaatctttgttggttgaagagataaaaaaaataaaggggattttgcgacccgcagaaaccattttagtagtagactctatgatggggcaagttgctgtaaatattgctaaggaatttaatgagaatgttggacttaccggtgcaatattttctaagtttgattcagatactagggggggagctgtattatcttttaaaagtatttgtgcagttcccattaaatttattggtgttggagagaaaatcgaagatcttgattccttttacccagaaagaattgcttctagaattcttggcatgggggatgttgttagtcttgtagagaaggttcaaagtgttgttgacaaagaagaggctattaagcttgaagaaaaaattaataaagccagttttaattttgaagattatctgagtcaatttaggcgcattagacaagtaggagggttttctaattttgtaagttttttaccaggtgtttcaaaatcaatgctgaatagcaataatttaaatgaagaaagttttaataaagaagaagctattattctttctatgactaaaaaagaaagaataaatccagtgattttgaataatccctcaagaaaaaaaagaatagccatgggaagtggaacaactgtttttgatgttaataagctcataaaaaagtttagtcaagcaactttgattatgaaaaaaatgaaaaataaagattttcaaaataagattgcatcccttttgggaaaataaggaggaataaatttgagcgttaagataagattgaaaagaatgggagctaaaaaaagaccttattatagggttgtagttatgaattctacgtctcctagagatggtagagcaattgaagaacttggttattatcatcctgttgaaaagcaaaaccaaataaaaattaaggaagatagaatgaaagattggataagcaagggagcaattttaagtgatacagtgaaaatgcttttaaataaaaacaacttgaatgcgaaaagtcaggaggtttaaatgaaagagtatgggaatgagattgaacttatagagtttatagtaaagtctcttgtagataaagaagatgaagtaaagttaaatgtaattgaaggggaaaaatcaactattttggaattaagggtttctcaaagtgatgtgggcaagataatcggaagacggggtcgtattgcgcgggctattagaactttgcttggagcttgtgctgccaaaaccaataggcgagtgcaattggaaattttagattaatctatgtttattaaaggcgttatattatcgtcttatggagttaatgggtatgctagggttaaaagcatatccaataatttttgtgattttattaatctaaaaaacaataaagttcttttaaaaaaaagcaatagttccagtgttgaagttaaagttgtagatgttaatataaagggtaattccttatttttgaagtttgaagagattgatactccagaggcagttaggccgctgattggttttgaattgtgggttgatgattcgcttgcatcgagtttaaaagaaggcgaatattatttaggaaagcttattggctatgccattgttaataataataaaaaactaggagaagttgtagctttctttgaatatttaaatagtgtatttcttgaggtcagagtgggtattaaatttttctttattccctttttaagtatatatattggagatataaatactcaagaaaaaacaattgagcttaaggttctagatcttttaaaatgaaatttacggttttatccctttttccagcaataattaagccattttttgaaaattcaataatgaaaaaagctattaataagggaatagtaagttttgagcttgttgatgttagagatttttcaaaagataagcataaaagatgtgatgatttgccttatggaggcggtgctgggatggtattgaaggccgaaccgatttcttttgctcttgagcatgtagagtctgccaagaaaacgacaatatttttaagtccttctgggataaagtatagccaagagttggcgtattccttgtcaaaaagagaagaaattgttataatttgtggaagatatgaaggaattgatcaacgtattatagatttgtatgttgattttgagatttctattggagattatgttttatcttcaggagagattgcagctcttgttttaatagatagtgtatataggttgctagatggagtaataaatcccaattctttattagaagaatcatttggtgtaaaaaatggattgcttgaatatcctcattataccaggccctatgattttaaggggataaaggtcccagaagttcttctttcgggacatcatgcaaatataaagaattggaggcttgttaaagctagagaaaaaactaagaaaaatagatatgatttataccttaaatatttagagataataggagaagataatggatttgataagaaaaattgaagctcagaataagaaaaatgaggcttttgtttttaatgtgggagatactgtgagggttgtttacaaaattattgagggtagtaatgaaaggttgcagagttttgaagggattgttatttctttccaaaacaagggaattggcaaaacatttttgattagaaaaatttcttcaggaataggtgttgaaaaaattttcccagtatattctcctattatagaaaaggttgaagttttaagaaggggaaaagttagaagggcaaagctttattatatgaggaatagaatcggtaaggctgctatgaagataaaggagcgccttactattaaaaaagttaagcattagtttttaattattttaaatattttagcaaattaggtcataagatgaatcaaattagattgaggttaaaaattgtttttgattgatcttttgttttgtaaatttttattcaagatttagtagagtttttgctgttttgggaaataattttggcaagcttggttgtgtatttattataattgagagcattaattaaccattcttattaaatttcaatgagggtttaattgtgcttttgtctttaaaaagctgaagatttaaagttttgattttttgaaaaactttcaggctatgtgagtgattttgttcttaaatatttgtttttatttttttgaagagtaaatatttattttttatagttaaggagagttaattttgaaatatactcaaagtaagttcaagagtagtaattttcagaaacacaataagcgtttttatggttttaagaataaaagattaaattctgagagcaaaagtcaaaatgttgccccgctaaacagttttaataataaatcgactgtcttgaatacagataaacaaaatgtttttaaaggtaaatttagaagaaaaagtataaaatttaaaacaagaataaatcttgatgttgcttgtgctatttgtgaaaaaaaaataaatgatattgtttatagcatgtctttaaaggttgaaaatgaagataaacctgttcattttgattgtgttatcaataaattaacatctgaaaataatctttcaagtaatgaaaaagtagtttataaaggtgctggtaaattttttattgtggatacatcttctagaggagaatatttatatttcaaaattattaaagaaattgaatttgaaaatttagaagaacaaccactatggcgtaaaaaaattctcaaagatattaatagggggtttaggctttcttgatatgagggtggcagtttttccaggatcttttgatccaattacttggggtcatattgatttaattaaaagatcgttggctatttttgacaaagttattgttttagtagctaaaaataaatcaaaaaaatatttcctaagtgatattgagaggtttagccttacaaaagatgttatttcgtctttaaatttttcaaatgtgcttgtagataggtatagcgggtttattgttgattatgcattaattaattctattaaatttattgttagaggaattagggcttttaatgattttgatatagagtttgaaagatatcttgttaataataagttaaattttgaaattgatactatatttttaccaagtagtgcagaacatttatatgtaaggtcggattttgtaaaggaattgatgttgaaaaaggatgttgatctttctaattttgttccagaattggtgtttaatagattaaaatctaagtttattgacaaatgacttggttaatatatatattattaagataatttaatgtagtttaaaagtagttaggagaaagtaatggctgttccaaaatttaagccttcaaaatctagaagtagaacaaggcggagtataaatatgagaaaaaaaattccacaatttcaagaatgttctaattgtggtaatcttggcgtgagacataggatttgtttaaaatgtggatattataggaataaccaatatctagaaataggtttgtagcttgtagtaaggaaggtgtattcatggataatgatgaaatttttagcaaggttaggtctattatatctgagcaacttgataaaaaagaagatgaaattaccacagactctagatttgttgaagatcttaatgcagatagtctagatatttatgagcttttgtatttgcttgaagaggcctttgatgataagattccagagaatgaagccaatgaatttgagacggtaggcgatgttgttaattttattaaaaagagaaagggttgatgaaaaaaaaatcttctgatttttgtttgtgtaatgaaagaaaatctcaattgagtaaatttttggaaaatttgagcattgactttagtaattttgatttattgaatacagcattgtgtcattcgtcgtattctaatgagttggatcaaaaatctagtaataatgagagattagaatttttgggagattctgtgcttaatttgattattacagatcatctttataaaacttatccaaataaaagtgaaggagagctcagtaaggccagatcttatattgttagtgaagattccctatctaatattgctagagagattaatcttggttcttatattttgctaggtagaggggaggagagtaatgatggtcgaaataaaaaaggcattcttgcagatgctattgaagcttttgtaggcgctatttatcttgatagtgggttttcaagagcaacagaatttgtggttggactttttgatatgtatataagattgatgtttaataggggggattttaaagattataagagtttgttgcaagaatatgttcaaaagaaatataaaatctcgccaagttataagctagacaaggaaataggtccagaccatgataaagttttttgtgtggaactttatgttggagaaaattttatatcaaatggaaagggcaaatctaaaaaagaagccgaaatgagagcggctgaagtagctttaaaagctatggaaaacattaacctttaaggttttgattttttttataagataatttttagtattaagcttgggattttcaattacacatcttagtagcatatttaaaattttacctatatttttgttttctatttgttctagattttgaatatcttttccgtttatttttaaatcttttaaagagagaggattttttagcaatttttttctttttatgttttttattataaataaatatcttttattttttcctttgagtgctttgtatatatcaattatttctttataatgttctcttgtgcttttgctaagcaaatatctaatatcacttaattttttgacattaaaaatattgttattatcgattatgcctctataaaataaaatcagcttaatttctttatttgagaatttaagtaaagttaatttttcttttagttcttttataggttttttaattgtcaatattgtgattgcctttagataaaatttgtttttatcaagtagagcaatttttttgattacttttgtttttatttctagattaaaaaaatttttaaaaaaatcaacttttttaagataataaattcctttttgtatatttatgccttctaacaatttgtgaaattcattttttattctttcttttgaaatcattaaaatattttcttttttatatttcattgaaattaaagtatttttttcaatgttaaaattaagtgtggatgaaaatcttgctgctctaagtattctaagggcgtcttcttcaagtcttttgtttggatttcctatgcatcttattattttcttattaaggtcttttttcccattatagcaatctattatgttgaagttgaaaatatccattgcaattgcattaattgtaaaatctcttctttcaagatctttaagtaaatttttagtatattctacttgtttgggggctctgttgttttcatattctttttctattctgtatgtggtgatttcaaagatttttttattaaaaataataccaattgtgccatgttttattcctgttttgatgttatttggaaataatgttattatttcttcaggagttgcatttgttgcaaaatcaaaatcgtaaggctgtttattaagcagtaagtctcttaaagcgcctccaactaaataaaattcgtagttattttttttaaatattttaccaattttaattatatttggattgtttttccctagattcatataaaattatattatagtgtaaataatttttttctaaaattgatttacaattttaatttatttgaagtatgttgtaagtagtactttattttttaaatggttttattggggttttatgagtggtaataacaatagcgtatacaactctataggtcaactttcaaaagagactaaagataggttgatgaatgatataagaaaaagcttaggtttgaattcttccgattttgttttgcccaatagtagtaatgagccttatgttgattctcagcttgaaaaatttctttcggggcgcttaatggaagaatcatttcttattagaatgtggttaactattttaaatttttttcagaaagataaaagcaaagaagatatatataaagcttatgttataaaaaacctggaaaatcaaattaatgaaatgtgtaaaaatccagtaatagattttaagagagaatgtttgcatgttggttttgtggaaatgttttttagtgtttgccgatattcaatggaattgaaagaattttttaggaaattagaaaaaggtggtattgttgttgagcaaactattttagaaattattcaaagcaaagttcttaactctaagaacaatttggaagattttttagatgaaggtgaatatgagctttttttaaaaaaagaaaaaacccaaaacgatttagaagaatctcttaaggtcaagataaatgaatatattaattctattccatctagtacttacaaaatcgtctcggatatgtttgagttttattatgtttttaatagtttggcgtttttcccttacaaatcttttttttcattttttaatgtagatcttttagatagtgctgagaatattagcattgttgactttgaggttggatttggaaccagcttttcaagtgttagtaagtatttgaattctttttttgacattttgtatacattaaaagatattgagatagatgaggatattgttaaaagcattatatcgaattatttttcaatatctgatgatattagtaattcagagataatttcaagagaagatcatatatctcgggtagaatatgtatttaaaaatgttttatctattgtatctaagattgttggcttgtcgaggactttgccttatttagatatttttagagtatattgcaaaaatcctgttgcatctcctaaaaaatatgtacccttttttgatgtaaaaaatttttatgagaacattttatttttaaatgttatgggtcaggctattaaaaagcgtgatagctctttaaaagttcttgttatcaaagaaataaaaaatcttgttagagatcctagtttaattttaaatttaaaaggcgagatttttaatgaattaaatcttgggcgttatagttttaaaaagttatattttcttaatgatttttttaaaaacatatatgatgttagaatgatggaagttttaagaactataaataatgtcgtattaatcaataatcatgatttgagaaatatatatgttgacattgaaaataatattactgctttgaaaaaagaaatttataatatttactttgagattgattataaaaatgaagagtttgaaaggtataaaagagacggtaaaattgataactcttataaggaaaggattttgaagtggtgcttaactgaatccgtttctattgataaggtttcaagtagatttgtggattattttattgagcttaaaaagaggtgcttgtctttgttggaaaatcataatgtttttattcgaaaatctttaacggtttcttacaaatcaatggtaactgaaaataaaacaattacattagccgatgttattggcaatcttttggaaatcataaatcaagcactttttataataaagaatttataaatttcatgaaagcttttaaagtaaaaaatctaagacgtttttcaaattttattagaattttggttattgtattgtttttaaattctttgttaagtttgttcgtgtttttggctggttcttacaatatttttgtttacaattttcagaaattttatcttgatcttgctattattttaagctctgtttcttttggacttgaatctactagactgatatttttttattttttgaaaaataaaaaaattaagtattatttaattttaatttttagttttataattttttttattgctcttgtttttaaaatttttctttctggtaataaatagattaataggaagattatattaattatttatcattattctattgactaatgaattttatttttataaactaactattagtttttgtttgccgacttagctcagctggccagagcagcgggtcttgtaaaccgcagtcgtcggttcgaatccgacagtcggcttttatggggcggtaccgaagtggttaaccggggcagactgtaaatctgttggctttgcctacgtgggttcgaatcccaccctccccaatttagtgaaattataagcgtttgcctttttataatttttattgtgatcttttaaatgtgttatgtcgtttcattttggtgcttttatttttgtctatttagaaaagttattattggttataaaatatgatgttagctatcaattaaaaattttaattgatagctaaagtgtaattagcaaagacttttgtttagctaggagattcttgtgcttattaaaattgggaaagtgtttattctttttttctttttgggatctattttgtcaatttttatatattttttaaatttatcttctttggcaaatggcttagtttatgaatttaatattgaaaaaggttggggagttaaaaaaatagctaaagaattgaaaaaacaaaaattaattaaatccgagctgcttcttgtttttatttcatatattttaggtagtgataaacaatttaaagaggggaaatatttaataaatggcgatctttctacatttgaaatatataaagagtttttaaagggatcttctaacgtaaatattgatgttacaatacccgaagggtatactagcagaagaattgctttaaagcttaaggaattttctgttattgatgatgttcaagattttctttttttaatcaacaaaaaatcatttatttatgagcttgggcttgattatgactctcttgaaggatttttatttccagatacttataaattttataagggtatagaaataaagaatgtagttcgcatgtttgttgataattttttgaataagcttaagtctataggcgttgttcttagcgattattcaagtaaggagctttacaatagggtaataatagcatctattgttgaacgtgaatatagggttaaaagtgaagccccaataatgtcttcggttttttataatagaataaaatctggtatggcattacaatcctgtgctactattgaatatgttattacagaggagctaggacgaagccatcctaagagaatttatttttcagatttagagatagattctccttataatacatatattaataaaggatatcctcctactccaatttcaaatgctggtattatttcgctgcaagcagcttttttcccaaaaaatacgcaatatttattttttgttgtaaaagactctaagttgggcacacatcaattttcatcagaatattcttcacatcttttaggggcaaaagattatattaaaaattttattactaaggattaagaagtatgaagtatttacaaactgtagcttcaatgaaaagcaaatttgatattgtagctattgtggagcaatatattaagcttgttaaatcgggatctgcttacaaaggtctttgtccttttcatgctgagaagactccctctttttttgtaaatcctttgcaaggatatttttattgttttggatgcaaaaagggtggagatgttattggatttttaatggatatggaaaaaatcaattacaatgatgctcttaagattttatgcgaaaaatccggtattcattatgatgatttaaaaataagtcgaggaagtgaaaataaaaatgaaaataaagacatggtttcaaaaatttactctttgaattctcggttaattaataccattaaattttttttaagtaaaaacaaaaaagctttagattatgttttaaagagtagagcaatatctaaggaaattgttgatttatttgaacttggttatttgccatttaactttaaaaatggtttagagcttcatgattttttagtttcaaaaggatactcttctgaagtacttagaaaaagtggtttgttctcgaaaaccaatcccaaagtttctattttatttcaaagattaatttttccaattaaagactttaaaggaaacgttgttggttttggaggtcgagatttagatgggaaaggttctaagtatattaatttaggtgaaactgaagtttttaaaaaaagggagcttctttatggattttatgagggttttgaggagattaaatctacaaaatcagttatattggtagaagggtatatagatgttcttgctttttttacatctgggattaagagagccgtatctactcttggcactgctttttcaaaagagcatttagctttaattcaaagatatgctgatgagataatattttcttttgatggggatgatgctggactttctgcaactttaaaagcttatcaaatttgtttgccgtttaatatcaatgttagtgttgttcgaatggattttggtactgatcctgcagatgttcttaaaagtgagggtgtagactccttgcaaaaaattttaaataatagatgtgatgcttttgaatatcttttggatgtttattctaataaatataatttaaataaaactgtagatttaaatgccatgattaatttatttttaaatttgataaatttatcaaaagtagatactcagaaaaaaatttttttagacaagctaagcaataaacttggtattggtgtgacaactttattgaaagattattacagaataaaagaaagatttgtagttgacaataataaaagaaatttgtatgctcataatgatgattcttatgagaggtatctaatagtagctttgttgaaaaattttagttattttagcatagtaaggcgcaatattattgatagtgatttaattaatgtcgatgccagaaaagtttttatgtgctttgaaaatttatttgaaaataataaagatttttcattaatggatttaaaaaaaaatttaaaggatacctataaagttagtgaattttttttgaagaaattttaaattctgaatttgaagtggatgatgagatgctcattcatattttacttgcaatcaagagaagaaaattagattctcgtgttttgctttgcaaaaaaagatatgatggggactctttggtaaatgctaagattcaaataaatgagttaatgtttttaaatatgcagagaaaaaatttaaaaatctacatagatgatgttccagggagttaggttttgtcggatttggaaaagaaatattcgaagctgatagagggtattattactcatttgggagatagaaaatctcttagttttagtgaattatcaaatttgcttcccgatgatatattagaaccagagattcttgattgtatttgttcggtacttgaggataggggaataaggttggttaataaaatttcggaattagatctggttgtcagtgaagatggaaatgatgaagaggaagaggttgagattgaatctgatagaaattttatgattttagatgatggttttcaaagtgatgaggaagatattgacattgatgttaagctggatgattgtgatgaagaagatatttctgttaaggatgatttaggttcagggtatattaaaggcaatgttttaaaagatagtcactcagaagatccaatcaagctttatttaaaggaaataggaaaagagtttttattaacgggaaatcaagaagttgaacttgcaaagcaaatggattctggagagagtataattgagaatattcttaagaatgagggacttgttatagaaaattattataatcttgtgaatactatttactcaagaatggaaagagaagagttttttaaaagagaaaaagataaggataaagagagtagtccggattattataataaaaaaaaaagaattgcctctttttacaaaattcctttaaagccaattcaagatcgtttaataagttatgtagataataagcatagggtgtatgatcttgggggggatatttttgaaaagaatttaaaaaaggaaagattggccctaaaagagcttttgagagacattcctttgtatcaagaggaattaaggattttctcagatgattatattgactctgctaacaaaataaaagatttacaaagacaacaaagaataattctaagcaggctgaaaattgaaaaaataagagatttgagggtgcttggaagagatttgactattgctgaaaaaaaaatagagatagaaaaatctctcaagcttaaagaagatgctattaaagagcagattacagaggctcagcttgcccaaaaagaacttgagagaattgagatgtattatgaatatccaactgataaaataataagcatgtcagaagagattgctaaagggaagcaaatgatgcagcatgctaaagatcagttgattaaggctaatttaaggcttgttgtaagcattgctaaaaaatatgcaaatagaggtcttcatttttttgatcttgttcaagaaggcaatattggattgattaaggctgttgaaaagttcgaatataagagaggttttaagttttcaacctatgctacttggtggattagacaagccataacaagatctatttctgatcaagctcgcacaattagagttcctgtgcacatgattgagcaaataaataggcttaatagagaaactagatatttaattcaagttttaggcaaagatcccacagatgaagagctttcagacaggcttggatgggaacttaaaaaggttaaaactgtaaagagtgtttcaagagaacctgtttctcttgaaacaccaattggagaagaggaagattctgttcttagcgattttattgaggataaggcaataaaaaatcctgcaaatcacacatcttttgtagttttgcaagatcaaataagagcaattcttggaactcttcctgaaagagaacaagaagttgtaaaaatgagatttggacttgaagatggctattctttaactcttgaagaggttggacttcattttaatgttacaagagaaagaattaggcaaattgaatctaaagcattaaggcggcttaaaaatcccaaaaaaactcaaaaattaaaagattatcttgaagatttaaattgaacaggaggattgatggaaaacaatattgatacattaaaaaaacttgaagttatatataaatctaagtttgagcttgaagaaaggcgaaaaagtattcccaagtatttggaggcgaaaaaaaatcagattgaagaattgtcgaaagttcttgttgatttgcaacaaaagtttaaggagtatcaaaaagaagactctgctttaaagttagatattcaagatattaattcaagaaagagcaaggctgaagaaaaaattgatagcattaaaacgcaaagagaatatgaggctcttgaaaaagaacttcaggttattattgacgatgaagttacaattagaaaaaagatgacacatgttaatgggcttaaaactaaaatagaaaaggaaatattagatgtcaacgagaagcacatcaaagaagaggaatgttttagagctgaaagcagtagttttgagctggagcttttagaaattgaaaagaaacttttagaaatagagagtgaagagttaaattgtgcttctaaaatgaatgaagattttttatttaaatttcaaagaataataagaaataaatcaaatggagttgtgcctttggttaacaatgtttgcaaaggttgtcatatgatacttcctattgaatttgcaaataaagtaagacgtgagcccaacgatattaaattttgtccttattgcagcagaatactttattatcaggataaagttcagataagcgatgaaataattcctggtagtttagcagatcttgttgaataaaatttattaatttgatactttttatttaagctggcagtcagccatcgcttagttttataattaaagcttaagaggaaagtccgagctccaataagaacataatgctaggtaatgcctaggggttttaaacctaagaaagtgtcgcagaaaattaccgccgtaaaaggtaagggtgaaaaggtgaggtaagagctcaccgcttatttagcaataaatacaggcaagataaacctcattaggagcaagatcaagtatgtaagcaccctttgttcttgaggacatgcttacgggtagatcgcacgatttttttagcgataaaaaaataagagagatgatggcatagtacagaactcggcttatgggtgtcagcttaatttcattgacctaaaagagagttttaaatggaaataagatatttaagatatattttttactcatttatgattttcattttcatttttttaatttattacattttatcatattttaaatctttttctagttcttatttaaaggcaggtccaacagaagttgatttgcttttactctgggataaaaaagaatataaagaaataatagattatgctgagaatgacattaaaaatcatagatttgattttaatttgaatttacttttaggattttcatatttttattattctttaatagtaaatgaagggtatttaaaaggagagtttttagataaatccatagaaagactaagatttttaatttctataaatgatggagtctccataagccctttgtattacatattgggaaaggcatattctcataaaggagagttttatagcgagcttgctgtaaaatttttaaagaaggccttaaatgccgataattttgatttcatgaacattagagaagatatttttgaatatttgggatattcgtatcagcttttaagagattacaaatctagtttgaagttttttgaaaaagcttttaatgaaaataaatctgatttagtgctttggagtttggcttatgttaattataagttgaatgatataaacaaaagcattgagtatataaaaaaaataatagaagaagagaaaagaaaattatcaaagggtgagaaaacggatgaaaatttaattcaaaaggtatatttgctttatggagacattctattagataaaggcgattatgacagtgcttttaattactataataaagttctagaaattaatagttcaaattctagcgtttatgttaaaataggagatatatatagaaagaaagataaagattatcctaaagctagaaaatactggagagaagctctcaatcttaatccttatttagaagcagcaagagagaggcttggaattactttggaagacttttagggaggttgttttgaatttgtttaagtcttttttgatagatattggcattgatcttggaacatgtaatacattggtttatattaaagattatggcgtggttatgagcgagccttctgttgttgcaatagatataaccaaaggtaataaagttgttgcggttggtagaaatgctaaaaaaatgctttggaaaactccagaaaatattaaagccgtacgcccacttagagatggagttattgctgacattgagaatacagagaagatgatcaaatattttattaatcaaattttttctcgtaaaaaattattttttaagccgagaatggtaataggtgttccaacttgtattacagaggttgagcgaagagctgtaaaagagagcgcaatgaatgccggtgcaagagaagttaaagtaatagaagaatctcttgcagctgctattggatctgatattcctatttttgaacctacaggtcatatggtgtgtgatattgggggtggaactacagaaatatctgttatttctcttggcggcatggttgtaagtagagcaattaggactggtggtgacgaatttgatgagagcataataaagtatatgagaaattctcataatattataattggtcaacagacagcagaaaaattgaaaattaagataggaaatgtatatcccgatattcaaaatttaagggtagaaaaaatagacattaagggtacagatgctgtaactggtcttcctagaaagcaacttgttgattctatggaagtaagagagtctttgcaagaacctataaatgttgttgtggatgaagttaagcgcactcttggtgcaactcccccagagcttgctacagacattgttgagcgtggcattattttgacagggggaggggctcttcttaagggtttaaatagacttctttcaaaagagactggagttcctgtttatgttgcagacaatccgcttctctcggtagctgttggtgccgggttattttatgattatgccaatagaatagatattagtaaaaatatttacagttttatcaatgaataagttatgaattttcttgtcaaattcaagaattttatcaaagtacttttggtattgatagtttctcttgtttttatgattcatgattcaagcagcattcaaaagagaagatcagataattttttgttttttactcttaattcttatattcaaagcagaatgcatggggtttttagttttatttccaatgtttttaaaactgtaaatgaatacaaaaattacaaggacaagatagaattttataaaaaaaggatacaacagcttgaaatagtcactcagaatatacagtcactaaggcaagagaatgttcgtcttaaagagcaattaaatttttattcgtcaagctctagcgattttatttcggcagagattatatatctaaactattcaaacatatcgactttaatggctattaataaaggattcaatgatgggatagaaaaagatatgatagcagttgcatatcaggatggatttagtggccttgtaggcaaagttgtaaaggtttattctaatactgctaaaattttgcctttaactaattatgaaaattttgtgtccgcaaggattcaaagtagtaggtttataggccttatagaaggcaatggttatggtaaaaaacttgaaatgaattacgttaatagacttgctgaaaaagatttaaaaataggggattctattgttactgctggatttagtgaatatccagttggtatttatattggaaagattacaaattttcatattcttgattataattctcttttaaaaatagaagtagagccagctatagttttagataagcttgagtatgtttttcttgttaaaaacaacaaagagattggtgaataatggcaacattttttacatattttatttccagcgcatttttaggcaaaatttttcaacactattttgcaacttatttttatttttcaatagatatttttttaatttttctagtttttaattctttgaattttatttttaatgtgggattattatctagcattttatatggtcttcttatggattattttacaggattaccacttggattttttgtttttgggtatacgataatattttattttaacaataaaataaaattattcatgcccaaaaatatgcttagcatgacaatattttttattctttcaaaaattatattatggtttttagctattgtgttttatgattttgtagacttaaaatcttttaattattcaattttcaaccttgatctttttgtaaatataatgtctattaactttttatatccaattcaaaattattttactagaaatttttattcttttaaagaggattattagtgggtgttataacaaattttagatacaagttcggcatattttttttaatagtaattatggtgctttatttggcgattttattccaaatgcaaattggtaagcatttgttttatgacagagaagccaatgtttttttatcaagattggaaaaaatcaatgcctcaagaggtgaaattttggattctaattccaatgttttggcaaataatttaactatgtttatcttaaagataagcttacaacagtattacaatatgcctgctgctactagaattgagatgatagattttttatcaagcactctagatattgataaatcaattattttgtctaaacttcaagagcctggtggatatcttaaagatgttgaaataattgaacttaccccaaagatgcttttcaaaatttctgaaaaaaagttttattatcctgctcttttgtggacctattcttttaagcgtaactatttagttgacgattcatattctcattcaatcggttatgttgggcaaataaatcaaagagaacttaggacgttttacaatgttagtgggtatgataatacttctacgattggaaagttgggcgttgaacaagtttatgataattacattagagggcaagagggattaataaaatacaaggtagattctaaggagagaagaatagacgatggttctattataaaaaatatggtgcccggtaatgatgttgtgcttaatatcaataaagatattcaagatcttgctaagaatgctttaggcaaaaggtatggttctgttgtagtattaaaaccatcaacaggtgctgttcttgctcttcacaattatccttattattctatgaaagatgtttacaataaagataataaggaagattactcttttttaaataaagcaattcaatctgtttacccgcctgcgtctatttttaaattagttgttgctgctgccattcttgaagaaagagttatagacaaagatcgtaaaatttattgtcctggatattttaaagttggaaatagaatttttcattgctggaagcccggaggtcatgggtatgttaatttagaagaggcgattgcacattcttctaatgtttatttttatacacttgggcttaagtatcttggagttgatagaattagaaaatatgcaaaagaatttgggtttggagaaaaaacaggaattgatttgccaaatgaagtagctggccttcttcctagtcctgagtggaaagaaaaaacttttaatcagccttgggtaggaggagatactgtaaatttttcaataggtcaaggatttttaaatgctactcctatgcagattgttaatatggttgctatgattgcaaatgaaggtgttgtatataaacctagaattgtaaataaaattttaaaaggtggtactaataaggttgttcttgaaaataaaccagaaatattaagaaagacaaatcttattagtaaaaacacatttaaacttctgaaaaaatatatgagaagtgttataacttatggtacagcaagatatgcagttcttaccaaagctgttgaggttggaggaaaaacaggtactggtcaaactggaatagatggttttgaaaatagttcttttattggacttgccccttataacggttcagctgataatcaaattattgtttttagtttggttgaggcaaaaagtaatgtggattggtggcctgcaaaatctacagatttaataatgcaaggcatttttgcaaatcaaagttatgaagatattcttaaaggttataggccgtggtatattaggtagattaatggtttttagaaaaaattatgattatttggctttgataagcttacttatagtttcttttgttggtatattgttgatttattctagcgattataatattagtggatctttaaccaagaatgaatatataaaacaaaccttttgggtaattattggattttttctaatttttatagtgggcaaatatgatttaaaatttgtttatagcatggtatatcctttatattttttattaatattggctttaatttttactgcattttttggaatgacagtaaatggagcaagatcttggattggcatatggaaacttggaggacagccttctgaatttggtaaagttgttattattttaaccctttcaaaattttacactgaaaaaaagggttataatgaattttttacctttattactgcatttttattaatttttccatcggtaattcttatattattgcaacctgattttggtacagcaatagtatatttaaccatttttatatttatttctttttttgcaggaatagatttgcactatgttttagcatttgcgttgatagggtttttttcttttgtttttgcaattttaccggtttggtatgaatataaggtgaatatgggtaatgtattttatcttattttctcaaatcctttttattttagagtaataatgggagtgctgcttttaattcttttgatttctgttttaggatttttcatttctaaatatggtttgagtattaaaataatttatttttatgtattttttgcaagttctattttattagtttcaatagtgttttcaaaggttctttcaaagttaatgaagacttatcagattaaacggtttttggtattcttagatccggctattgatgctaagggtgctggttggaatttaaatcaggttaaaatagcaattggttctggcggtcttttgggcaaaggatttttaaagggaccttatacccacgctaattatgtgccatctcaaagcacagattttattttttctattcttgccgaagagtttgggtttttgggtgttagcactattttaatattattttttttccttttttttaaatttttgataataatgaataaaagtcaagatagatatatggccttagtaatatctggaattttgggacttttattttttcatacttcttttaatgttggaatgtctttaggagttcttcctattaccgggattccctttccttttctctcttatggaggttcttctactattacattttttttagcaatgtctttttattttaatattgaatcaatagttgctatggattgaaaatttattttcaggtttttgttttcttatctctatttttttagaaaatttttttgtatattttaatttagtaattataaatatttgaggtgcgtatttttacgtaaaagtgatgagtgtgaattttaattttttaataaaaagcgaaaggcaaaaggtattgttgtgagcaaagatttagataaagaagatattctttacaaaaaaagacactcaatagctcatgttatggcagaagctgttcttgatttatttccaaataccaagattgcaataggtcctcctattaaagatggtttttattatgattttgaatttaaaaagcagattacagaagattctcttttagacatagaaaatagaatgagagaaattttaaagaccggaagttcttttgaaaaagagataataagcgtagaacaggctcttgaaatttttaaagatgaaccttataagattgatttgattaaaaattttgatttacaaaatgaagtttctatttacaagagtcacaattttgttgatctttgtagaggtcctcatgttgagaatatgaataaaattgatccaaaggcatttaagcttactagtattgctggggcttattggcggggcagtgaaaaaaacccaatgcttaccagaatttatggaactttatggaataatgaaaaagaactgagatcttatcttaatttgagagaggaaataaaaaaaagagatcatagaaagcttggaaaagagcttgatttattttctatacatgaagagattggaccaggacttgttttttttcatcccaatggtgccaaaataagagctttaatagaagatttttggagagaagagcactccaaaaatgggtatgatattctttttactcctcatattggcaaatcttggctttggcaaacttctggtcatttagacttttataaggatagcatgtttgaaaaaatagaaatggataaaagtgattattatcttaaacccatgaattgtccttttcatattgcmatttacaatacaggtaagcattcttatagagatttgccatttagatgggccgaacttggcactgtgtatcgttatgaaaagataggtgctttgcatggtatgatgagagccagagggtttactcaggatgatgctcatattatatgcacccattctcaggttttagatgagattaaagaagttcttaggtttgctatttatatgtggagtaaatttggctttagcaacccaaaggcatatctttctacaaagcctgacaaatctgttggcaatgattctgattgggaaatgtctttaaaagttcttgaagagactttaagcgattttgaagttccttatgaaattgataagggtggaggtgctttttatgggcctaaaattgatcttaagatagttgattcgcttgagagagagtggcagatgagtacaattcaatttgattttaatctccctgagagatttaatatgacttataccgctgaggatggtaaagaaaaaagaccatttatgattcatagagctttgttgggatctattgaaagattttttggaattcttgtagagcactatggtggtgcttttcctttatggttatctcctgttcaagtagtaatcattcctgttaacaatattgtcgaagattatgctattaaggtttttaataaatttaaaaatgaggggattagaataaagcttgataatagttcctcaagaatgaatgctaaaattagagaatatcaggctaaaaaaataccttatatgtttataattggtgagagagaagcaacagaagagagaatatctattagaacaagaacaaatgagcaaataaatggaatgaaacttgatgaagctcttaaatttattttatttaaaataagagataaggagatttgataaattgaataatttaatcaaggtcattacccctaataaaataacattagttagaattgcactttcctttatcatattaattttattttttttggaaaatgtatttttttcgtatttgttttttggaattatttggtttttaattatttttaatgaatttactgattttattgatggttatcttgcaagaaaatatggtcttgttagcaatgtaggtaaaattttagatccttatgcggatgttttgcagcatttaacatattttgtttttttcttttacaaaggtataaccccctattatttttttgtaatatttatttatcgtgaaatttctattgggtttgttagaaatttaattattcagtttaatgtagttcaacaagcaaattttttggggaaattaaagtcacttctttatgctgtttgcacttttgcaagccttttattttatactttaaatcaactcaactttacagagtctgttcaaaattttattagttacattttaacttttaaatttaaatttttatttattgttcaaatgacatatgtttgtgctgctttttttgcaattttatcatttttagaatatgtgttaatatttttgaatgtaaaaaaatatgaaaataaataagacattcattttgctatttttatttacaaaattttcttttgttcaagctcaagcaaatcaaatattaacagaaattagtcctttaagtattttaagcaaaaatgggaaaggaagtgtttacttaaaagttagcaaatcttccgattatattttaaccctagataagagttcaaattccgattttgtttttaaaatttatgacatttctaataaaaaatatataaccgataaagtaaaaagaagagattttaaaataagattagataaaaattctctttatgcaataatatatgttggtactaaaaatgaaaacataaagttttcgcttacagatttagatttttcaattttaagtagcgattccctgaaagctaaaacatctaagattgaaaaagaagatttattttttactttaaaagatttgcctgttttaaatttaactgccaagcttaaaaaatatgtattaaggatttataaaagcaatatttatattgcttatcagctagaaaatagcgatgatattaaagttgctgaatttattgaggatgttggttggtttaatcttgattcatctgttaatagaaatattactaatatagttaattttgatttttcaattaattctaaaggaaatttatatattgcttttgttacgaaatcaggggctgattttgccagcgagcttatagttaaaaaatttaatagtagaaaatggattgatattagtcctggtcacatagaaaattttggatctttattaaatattagcattgatttaaaagataggttgtatttagcatatttaagggaaattaggggtgaatataaaattaatttaatctcgaatatgggttacggaagtatttggaccgatgtaatacatgcttatttaagtaaaggtgattctaatgttaattcatcaaacattggtttaatatctgaaccttttttgggcattttttataattataagtcaaataatgagattaaatctgaatttattgtaaacaatgaaaatgcttgggtaaatgcaaatattccttctgtttatatggccaattttattaaaggcttttttgattctaattttaatcaaataattatgagttttgtttctgaaaatagacctattgtaaacatttgtcctttgaaaagtagtagatggattaatataagtcctaatgttgaaatggaaggtttaagtgctgacattgggctttataaaaataatttgtttttagcttttgaggacaataataatgtgagattaatttattttaagaataaaaattggtattttttaaataagcttgagaattttaagagtaatgttaaaagccctcagattggaatttatggcaatcaagggcttgtaatctctactttaagctctaattccaatgaattattttttactttgatttgccaatgaaagtaattcagagtaaggtctagtttcaatgttttcttttaatccaaattggttgattatgttgtcaatttctttttttgccaagtctatatcattttgattgttaattattttttctatttctaaaaaaaacccaagattttttatttcgtttatctctacatttaaattgttagtttgataaattaaacttttttttatctttttgtatagctttttaaatttaagctcttttataagggttaaaaaattattaatactatctattttgaattctatctctttattaatttctacagtattgttgttgtctaatattttttttttgaatgtgacaattttttctagagtatttaattttcttattcttataatttttttttggtttgagtaataratgtcagtttttatttcttctttaataaacttaaattttttatttgctagcttgataattctttttaactcttttgtaggaataaatgcttttgattctatttcaaacatatattaaaaataatgtaattatgataatatttcaatgttaaaatattatgctatataagataaatttttaataatttaaacaactttttgtatgatatgttgaaatttgaatttagcgacaggtttttactttttagttattttgttttaattatgtttataggctctcttttgttgatgttgcctatttcctgggaaggtgatggcaaattagcatacattgatgctctttttactgctgtttctgctgtaagtattacgggccttacaacggttaaaatggaaggcttttctacttttggatttattttgataatgttgctaatccagcttgggggacttggatttataagtattactactttttatttgcttatacctaaaaagaaaatgaatttaacagatgcaagaataataaagcagtattccctttcaaatatagaatataatcctattagaattttaaaaagcatattgtttataactttttcaattgaaatgataggtttaatattaatacttatttgttttaaacttaggggagtgaatatttcattcttagaggctttgtttacgacaatttctgctttttgcaatgcaggtttttccatgcattctgagagtatttatgcatggcgagatgttcctgaagctatagttgtggtctctattttaataatttgtggtgggcttgggtttatggtctatagagatgtaaataacactattaaaaacaaaaaaaaactatcgcttcatgccaagatagttttttctttaagcttctttttaattataattggtgcaattttatttttttttacagagatgcataaattaaaagctggttattcaatgagcactttaatatttaattcaattttttattcgattagtaccagaacagctggttttaattatcttgataattctttaataagcggaagaactcaaataatttctctaccattcatgtttattggtggtgcacccggatcaactgcaggagggattaagattacaacattttttttaattgtattggctgttgttaaaaatcaaaacggcaatggatatattattggttcttacaaggtttcaatagatagtataagatttgcacttttattttttgcaagagctatttttattttaagtttttcttttttcatgcttcttttttttgagggaggatctggcaattggaaggttattgatttaggttatgaagtattttctgcttttggaacggttggtctttcagttggagtaactcaggatttgtcattttgggggaaagtcattataatttttactatgtttgcaggacgaatagggcttttttcaatggctgtttttgtttcaagaaagtcgcgttttgaagaatttacaaggccaaggcaagatattttggttggttgaagcatatgaaaacatttgttattattggacttagtaatttaggcattcacttacttgaagatttaagcaggcttgattgtcaaattattattatagatacatctaaagagcttattgaagaatatgatgtgatatctacagaaagctttgttgttgagcaattcactaaaaatgctttgaaaagaataattccagtagatacagacgctgttgttattgattttgatgatgatcttggcaaaagtgctcttgttactcactattgtaatcttttaggtttgaaagaaatatgcgttaagacagaaaatagagatgatgctgaaatcttaaaaactcttggggcaacaaaaattatatttccaagtaaagatgctgcaagaagattaactccattattagtatctccaaatctttcaacttataatattattgggtatgatattattgttgctgaaactgttattcccaaagaatatgttggtaaaactctttttgaagccgatcttagaagagaatgtgggattacagttattgctgttagaaatttaagtaattctaggtatgaatttgttgatggcgattatttttttttaaaagatgataaaattgtaatttgtggtaaaccagatagcattgaaaattttacaaataataaagatttaattaaagatttaatttcaggctctaaagaggatgaaaatttaaataaagatgctgagaaaaaatctagatttttagggattttcaattttatgaaaatttttcaaaaagatcgtaaggataattaggatttaagaatgactaaaattattcctgtggcaagtggcaaaggcggtgttggaaaaacatcttttgttgcaaatgttggttataagctttctagtttgggtaaaactgtaatacttgttgaccttgatcttggtggctctaatctacatacgtgtttgggggttaaaaataagggtgtgggcattggttcttttattaataaaaagagtaaaagtttttcagatttagtatgtaaaacatcttatgataagctttatcttattccaggtgatgctctttatacgggaacagctaatcttcctttttctattaagaaaaagattatagaatccattcaaaaagatcttattgctgattttatttttttagatttgggatctggaacttcttataatacaatagatttttatttggcatcttacagcggtgtaattgttacaataccagaaaccccttccatacttaatgcttattcttttttaaagaatgctctttatcgtcttttatatttaggatttccgcaaaaaagccccgaacgggattatattggtaatttttttaaagataagattgaggggacaaaccttggatttaaagatttggttgttgggattgaacttatttctttgagttcctctttgaaagttaagaggatgatgaataatttttatcctagagtggtgctaaatagaatagaaactagtgaagagattgctatgtgtgaaaatttgattaatgttgttaagaataatattaatataccaatagagtttataggttttgtgccttttgcaaaaagtttcagagaggctattaataatagagttccatttattgattttgagaaaaattcaaagttgaataaatattttgaattcatagctggtaatttaattaaatctcctattgaagggtctccttatatttacgatgacatatacgatatgattaaagatcaaagtcgatttattagaaaataattaggttataattctataaaggagtatttggtgtatagaattaaaaatgaaaatttagattttaaaatagatagcttgggagaatgcaagcaaaacaatcctttgattgatttttatgctagtgagggttcttcccattttgttaatgaaaaaaataaaatcaagtttagtgtatataggaatgaggataagggagataggtatgaagatgttcttttagaaaaagctgggcctagagaaaaaatttattttgtgcccaggcatgttaaagctgctattactacttgtggtgggctttgtcctggttttaacgatgttattcgctctattgtgcgaactttatggaaaatatatggggttcgcaatatttatggagtaaaatttggatatcaagggcttcttcctgagtcaaattcaccttttattaatcttaatccagatgttgttgatgatattaataaatttggaggtactattcttggttcttcaaggggtggtattaagcctgtggaaatagttgatactttagagagaatgaacattaatatgatttttaacattggcggggatggtactcaaaaggggtctcttcttattgctgaggagatagaaaaaagaaatttaaaaatagcagttgtgggcattcctaaaaccgtagacaatgattttatgtttgttcaaaaatcttttggatttgagactgctgtagaacaagctgttgcagctgttgctggtgctcattttgaagctaatagtgcttataatggcattggacttgttaaagttatgggacgggattctggctttattgctgctcataccgcactttcttctaatgatgttaatttttgtttaatcccagaacttgattttgacatagaaggtcctaatggatttcttgttcatcttgaaagacgacttttagagaaagaaagcttagaagagattccccatgcagtaatattgatagcagaaggagcaggccaaaaatattttgatcattttcctaagaagaaagacgattctgggaatttgctttatgaggatattgggctttatattaaagataaaattacagaatattttaaagcaaaaaatatacaatttactcttaaatacattgatcccagctatattattagaagttcacctgctaatgccagtgattcgctttattgtgctaggcttgggtcgaatgctgtgcatgctgcaatggctggtaagacaaaaatgttgattagtttatggagtacaaaatttgttcatatacctattaagatggcagtaattgacagaaataaggttaatccaaatggttctttttggagagatgttctttcaagtacggggcaaccaattagcatgaagaattaaattaatttaattctttctatttggcagcattgccagcaatatttaatatatcccaagttcttgagaagggtggggaatatgagaaatccatcatccctagctcttttgttgtaagttttgaatagattgcaattgataaagcatgaattcttattacggctccattttttcctattgcttgtgccccaaggattattttggtattttcctcataaattaatttaatataaagatcttcttggcctggataataatttgtatgatttttgtcctttacaaaaatcgttttatattttatttggagcttttttgcatctttttctgtaagtcctgttcttgcagcttctaaagatagtattttaattgaagctgagcccaatgtgcctttaaatgctgtatgattcccagctaaattttcaccaactattcttccaagtttgttggctgttgttgccaagggtatgtattcattttttttacttactatattataaatagttgcacaatctcctgcagaaaaaatattttttatgctagtttcgccatactcatttacaattattgctccatttttagtagttttaagctggttttctaaaaattcagtgtcaggttttattccggtagcaagtataacagcgtcagcttgataagtatttttgtttgttactactccttctgcctttttttctcctattaaactttttacaaactcatttgtatgaagattaacccccttttttgttagttcttcttccattattgtgactatttcttcgtcaaaggaatctatgagtatgtgcttatctagttgaattaatcttacattttttcttttattttttgctgcttctaccatttcaattccaatgtatccaccaccaattatcactatatttttaatctcttctctatccattaatttttttattttttgaccgtcttctaaatttttcagagtatgaaaattttctagattgatattattgattggtggaataataggttttgcaccagttgctatcataagttgatcgtaagtattgttaaaaatggttcctgttttttgattttttattacaattgtattgttttttgcatctactttgataacttcgtggttagttttaacagagattccagttttttcgaattcttcttgtgttcttgagatcattgtattggggttgtcaaagaatccccccacaaagtaaggcaggccacaggttccaaaagatacaatatttgttttttcatagatagtaatgtctagctttttgtttaagcggtttgctttagctgcggcactagttcctgctgatgtgcccccaataattattattttcatcattgttttcctatttatttgtttacaagctctttttggttgtatatattatggttgaattgtttgagctgtttagcagatataacgcctgcaagcattgagccgcctacattaacagctgttcttcccatgtcaattataggctcaacagatattacaagtcctaccaatcccactggaaagttcattgctgagagcaccattagtgaggctgttgttgcgcctccaccagcgccagcagctccaaatgaagttattattattaatccaataagtgtgagtataaatgaaatatctgtggggtttattccctgagttggtgctatcattattgcaagcatagcggggtgtagtgctgcacaaccattttgcccaattgatgttccaaaggagcttgataaatttgctattccttcgcttactcccagatttttagtttgaatttctatattaatgggtatggttgcagcactcgacctagatatgaatgcaaatgatagtgctgggaatattttttttataaaagtaattgggtttaatttatttattgcaattaatgtcatatgcataagaaatgtaagacctatggcaatgtaggaagcaattacaaattctccaagctttattatgcttttgatttcgctggttgctgtaatttttgtcattaaagctaatatagcataaggcgttagttttaaaatcaaagttactacacctaatattatgtcttggagtgttaatattatttttttaaaaaattctattgattctggctttttgatagatgttttaagggcggctattcctatgatagctgaaaatatcacgaccccgatggttgagttttttctaagccctgcaaaatcttcaaatatattttgtggaataagatctgtgattttttttgtgattgttgtttgatttaatatttcaaggcctttttgcaatttttcactttgtaaaatttcgatggttcccgcttgtagtccttcggctgttaatcccaatgctaaagcagtgaaaatgccaattatggcagcaatacctgctgtaaatactagtgttaatattacaagtaggctcattttcccaacatctttactattggttagttttattattgcagagattattgatgttattattaaggggattataatcattttaaggagccttacgtatccatcgcccaaaatacttatccaatttatagtttcgtttgttatttctgaatttgttccataaaaatattgaatggtcattccaaatactattccgattgctaacgctataaacactctttttgtaaaagaaacattttttcttttacaaagataaactatgcttattagaataagcattattataatattgattaatgtatataatatacttattttatccattattacctcttatataagcttagtgcattcttttttaaacttaagggggtatattcaaaaattaattaatcttgttttaaaatttttttagaatttttttagaataagattctattacttcatctttaaaattgtcattttttaaaatttgatttgcaataatttttcctagctgaactccttcttggtcgaatgagtttatatttaataaaaatccctcaaacattactttattttcataatgggagagtattgctcctattgcataaggtgttaattcttttgaatatattagtgcagaaggtctctcgccttggaaatttttatttttattgctattttctttaccttttgaaaatgctattatttgggctattaaatttgcttttaatttatcattgcttgagctgttatcagatattacatcttctttaagttgtgtttcattaaaacctatgaaatccattggaactatatccgttccttggtgaagcatttgaaagaatgagtgttgaacatctgttccaatgcctccccaaattattcttacagttttgtagtttattgtttcattaaatctgtttacactttttccattactctccatttcaagttgttgtaaatgaagataaaaattttccattgctttagaataagcaatgatgcagttgctactgtaatttagaacatttctttcatatatgctaattagtgctgccaagagagatgcattgtcttttacgtttttgtttaatgattttttgtcagcctcattggctccttttagaatttcttttgcaactttttctgtgaagcaaagagtaagtagtgtaagtccaactgctgatgttggagaaaatcttccacctattgagtcatgcatgaagaaatattcaagatatcctttttcttctattgccaacatgctatcttttagtgttataatgaccatttgttttttatattcttttatgccatttaattttaatttgtttattaagaattgcatattagctttagtttctaatgtatttccactttttgagacaataataaaaagcgtttcatcaacattaatgctgcttaatacttcttctgattcgtctggatcaatgtttgaaataaaataaccattcattagggctagattgtgtttttttgcataattttttattgagctgtaaagagcttttggccccaggctagatccaccaattcctatttgaactacatttttaaactttttgccatttgaacttttaatgttcccagaatgaatttgctttgcaaaattatatattttttcaagttctgattggaaaaactctctcatattttctttattgtcttctattacgtccttaccaatttgccctcttgtaaggtgatgcaggacttttctattttcactaatattgatcttttccccatcaagcacttctttatatttttctattaaatttgcttcatcgcttaaattttgaaaaattttaaggtgggtttcattaatttgttttgaagcatagttataatgtacactatctccttctattgtaatgtcgtattcttttatcctttttccagttaatgccgttttgagcacttctggagcaataccttcaaggattttaaaattttcaagttcattaagatttttgtaatttaacataaacacacctctttattatgatttaaatttttctatttcttattttacacatgtttttaatttttaagataataaatttaaggaatcttattattatattgctttcagaataaatttttaagtaagcttctccttcgtttgcctcgcttcttgtgaatgattttctaacattattctcatcaagttcaatttcaagtaaagtttttttgttttcaattgagattacctttacttcaatttctttatagcctatttcttttaaggcctgatatcttctaagtcctgctatcaagtttttatttttatctattattattggataaattaatccatgttttataatactgtttttaagagtttcaatgtctcctatattttttctaattcttttttttatttttatttgatcgatatctattaacatattgttttaatccaattggatatcttctccgttgacgtctttgttgttaattttttcattttcattgttgtttgaatttaattcttttgtgctttgtgtttctatgtttgtttcattaacaatgacttcgtctttaatttctttggtgttttcaataagcatttcctggttattattgttattaactagatcttgttgtggatttttattttctatttcatttaagggttcttcaatgttcatttctatttcatcttcatttttattttcttcattatcattaatgctttcaagatcattgttattattgttaaagctttcaagattattatcattattactattgttattaaagctttcaagattattatcaagatattcaaattcaggagtgtcaaaatttatttcatcgttattattaatctcatcaattccatatatgttaaattctattgtatttttaaattcttgtttattttcataatattttgatttttcaactggctgggtgccggaaataaatagttcatttattattttttcatcagcaatttcttccggtagtagacccgtttctgcttgtacggggatgctaattattcctgcaggttttacaaaaacttttttgggtaagtttttgtgatattctgccataaattctccccaactaggccctgccaatcctgttcctgttccagatattcccagtgaatatccttttttgtcaaatccaacccaaaatgctgttgttatataaggagagtatcctattgcccatccgtctgcccaattttgtgttgttcccgattttccagcaatgtctgatttaaaatttttgagatttgtatatctttgatttgctagggttccgtattgaattgttgatttcatcatatctgtgattatgtaagcggtttgaggagatactatttgagtttggtgttctttgttttttattttagccaatatgcttgcttcttcatttgttattattcttccagctctgtcttcaatgtatcttatcccataaggttcgatttcgctaccactatttcctaaaattgcaaaggctcttgccatttggattggagaaactgatattacacctagcgctagtggataaacttttggaaacgttttttctatttcttttggatctgttattcctagtagttttgaggagtagctaattgcagagtcaaagcctagccggtctaatattcttaatgccggaatatttaaggacaaagctaatgcttggcgcgttaaaacgttgcctctccatttgccgccataatttcccggagcataaacttctccatttttatttagaaatgctactggagagtctgaaaacattgtcgcagctgttattttttttagatcaattgcggctgcaaaatataatgctttgaatgcacttccaggctgaacttttgcttgtgtggctcgattaaattcattgtctttagtgtgtccacttcccccaaccatggctcttattgctccacttgttgtatctattgctatcattgctccttcaggctgtgcaataagtttcggtgttaatttatttttgataatatattcttttgtcgccttatctattttatcaattccaagtatagctccaaaacttgcaattagatcaatattgtcttcgtaaaattttctttttctcagttttttatattgtcttccatttattcttaaatttttaattcccaataaatctgatatcgcatctactacagggacaatttctgaattaatgattattgtttcagatgatctatttaaattgtgcattgttcttgctttattaatcatgtcgtttgtaactttatctgcatatttttgtgcttcaagatcaagggttgaatatattgagtacccatctttatatatgtttgcgccatctggtaaatattttagtattttttgccttatatattcagagaaataaggagcttggtcttttttgtttgaaattgcagatgtgtcagccattctagtccaatcataattttgccagtattcattaaattctttttcagcaatttcagccttgactattccatttgatacaacttggtttaaaactgcacgttgtattttttttgaaaattctggattgtaaagaggtgaataaagttttgcatttggaagctggattatcatcattactgattctgctgtattgattttatttacacttttgccaaaaaagaattttgatgctgcaactattccatagtttccgtttccaaaataaactttattaaggtacttctctagtatttcgtattttgagagttttttttcaagttgaattgcccaccatatttcatgtaattttctcaaaatagatcttcttgcttgatttgtgtagagaagctttgcaagttgttgggttaatgtgctgccgcctgaaaaatatctgccaagaacaatattaaatgcggctctaaatattcctatcaaggaaaaacctcgatgagaaaaaaaaccaatatcttcccgtatcaaaagcgtattaattagattgtcaggcatttttctcaaaggcattaattctctgttctcatcagatataaattgagttatttgttttccattaatatctaaaagtcttgaaggaactgctggatttacatatccgaaatttttatctttttgtatgtttatagtcttagatactgctaatgagagtgtgataatagaaaagctaactgcgaaatatgttaaatatataagcagcttatgcgtatttatttttttcaaattagggctattcaatttcatactttttactaaagtatactataagtgcataagaattaataatgttatgggttgattgttatagtgtaaaattattgttataattttacactatgtaaacagcattttgtaagttttgttaattgaaagatgctgtgagaggtggatgatggtatgtttttgattttaagggtagatttattgatttttggctaagcgtgtttatagcttaattgttttaaacttttttatttgtgtaaaactgtttaaaacaatttgaagctttgtttagtatttttatattcaaaaaaaggagaaaggagaggtttatgcttttatctagaaaaataagagattatggggctaagtataggggtaaagagattaaaatgagcacagagataaatagttttttaaatcttcgcaatactattgagatgagaataggctcttataccgcttttggagtaatttattctatttctatggattctcttaagcttatttttcaagaagatacagtattgcccgctttggctaaaaataaaaatttaggctctattcaacttaagaaaaattcagattctaagagtagtgcagcttttttcccttttttgtctgtaaaactattgagtgcttctgcttattcttctttgaataaagaatacaatttattaacattagaatttttatctcctgcaccagaagagattgctattaaagttggaaagcttcttgatttaaagcttgggcaaaatcagagaattcatgagaggattattatcgataaagattctattagaaagctaaaaattgattctgataaagcttttatcaagtttaatggagcaaaacataaatgcttaataaaagatttatcttatgggggtgctttagtaatttcttcttttgattatggggatgtcgaggaagatgcaattgatttgatttttagttttgaatttatagatggagaaatttttattgaaggtaaatcaaaaagcttaagcgttattcagactcccagcggaaaggtttttgcgcttggtattgcttttgatgaagataaaataccacttgagtatactatgttgatccatgattatttcaattaatcaaaggattgaaatttttcttatgtgattatgcgaaaatttacttgtaatatttaagtttaagtcttcttggttgtatttgctggttttgctcgggttgggaggagaggtgtggcgtgttttagacttttgcttttagctttagcattattttattaatgaatatttatgctttttgaattattttaaataacaatttagcgtcattttttgttaatgaatctatttgaactagcttttttgattctattgtttattgaatgtccaagttcttcgtcttttaagaattcgctaagtatttgtttgtagttgttttcagaatttaccaactctttgtaaaggttttgtgcatattcttcaagagtgttaaatactgtaatattttttttattccaaaaaaaattgaataaataggattttagagtagcttttgtgataagtattttcgtatctttgtttaagtatcttcttatgttatcttgacttttaaataaataaacgggaatttttggcttataatgttcaattatgtttccaggtgatttttctagttccatttttgtttctgcgtaatttactgtatattttccttgaagttcattttctatcattttttttgttattgcgcctggtcttaatatcagtacgttatcttttaggtcaaacccaaccacagttgattcgattccaatattaaagtctttgttctcttccggttttattattcctcttacaagtccatttaattcttttaaggccatttcgaaatttgttgagcttggtctttttgatatgtttgcagacggtgctactatggggactttagatgcttttattaggcttaaagctgttttatttgcaggaattcttattgccactgtgtctaggtttccacttacaaatctagatatttttattgattttttaagaacataagttaaagggcctggactaaattttttgattagcatgagggcacttttgggaatatattctgataattcttttattttttttaccgtatcaacatgtactattaaaggattgttgatgggccttttttttactaaaaaaatcatttttacagcatcttcattgtaagcatttgcgccaattccgtaaactgtttctgttgggaatactacaagttctcccattttgataagttttgctgctttttgtatttggctgctgctaattatttctgttgatatcattttttagacttttttctttttataattaaatcaaaaaaaatgtaaataagcaatttgcaagcttaattgtttattgaaatatgtttttatattataataaacattatgagaaatttaattgatgccatcttaagagataataaaaactttgtttttctctttgtatttttttttattgcttctcatttaaattctgccacagtgggtcttgcttcatggtatggcgaagcttttcacggcaaaactactgctaatggcgaaaaatttgatatgatggcgcttactgctgctcacaaagaattgccctttaatactaccgtaaaggttacaaatcttttaaataatagatcagttgttgtaagaattaatgatagaggtccttttaggaaggatagaataatcgatttgtcaaaatatgccgctgagaagcttgattttttaggaataggggttgctcctgtaaaaattgaagtgattgaaagttcgaatgaaaaaagaccttctgtatcaaaatctagtgactttaaaaaaacatttaatattcctggggttaaagaagaaaagaaaaccaagcaatcagacgaaaatatttctgttaaaaataaatccaaagatttattggcagattactcagtttctgctgacaaagaaacagatttttacatacaagttggatcttataggaaaaaagattacgctgatagggcttatcgaatattaaaaaaagcgggtctttttgttgtagtaaattctcatgggccgttttataccgtttttattcctactaatgccgatgatgttcaaaaaaatatagaacttattaaatctgctggatataaagatactttaataagaaaaaccaaggttccaggcgagagccttattatggattgattttttaaattatttttttattaaaattatttattaactttttaaaattttatgattatgtcctttattgccggtccttttgtggtatttctttattttaaaaatttcaatgttatttttggaaatttaaatttattaaacgactgttttactttgtttaaatttgtattttattgttatgtagttattttatgaagtttttatttgatattcctcttccaattatgattttagctccaatggaagatgttaccgatactgtttttagaaatttaattcatttaataggatctgcagaaggagaacctcatatttattttaccgaatttatttctacaaaaggaattttaaatggatcaaaacaatctgttcaacatgtttttttaaaacccaatgaacttaataggcctttaattgctcagatttggggcaatgttcctgagcaattttatagagcaatagaaatattagggagcatggggttttggggaattgatattaatatgggttgtcctaagagtaaaataattaaaaaaggagtttgttcagctttaattaataataaatctttagctaaagagataattcttgcaagcaaagaagcttgtgcgagatttaatttgcctcttagtgttaagaccaggcatggattttcatatccagaagttgatgattggctggggtttttgttaggccttgaaattgatatgttaacggtttatccaagacttgctgttaatcagagcaaaggtcctgttaattttgatattttttatgaacttgttaaattacgaaataatcttagtccttctactctgattattggaaatggggatgttttgagtctcaaggaagctagatattatgttgataaatatttaattgatggaattatgtttggtcgtggaatttttgataatttgaatttatttaagcccttttcaaaacactttttagatagtaatttaaattttaggttaaatatattaaaattccatataaaggattttcatgctacttggggacttgaaaaagattttaataaacttaaaaaatattttaagatatattttactgagaaggaaagacagagtaagtatttctcaaatcttataaattcaaaaacttatgaagagctttttgaaaatttaaaagttattgacatggtaggagatttttaaacgatgaattgtagacctcttgaaaaatatgatcctaaggcatttgaagatgaaatttacactaagtggcttaaaaacaatgtttttttgccagataattctttatttgaaaaatttagtatggttgcgcctcctcctaatgttactggcgtgttgcacatggggcatgctcttaattttgttttgcaagatgttcttgtaaggtataaaagaatgaaaagacacaatactttgtggctttttggcacagatcatgcaggaatagcaacgcaggctgtttttgaaagacatcttaaaaagattggtaaaagcaaagatgattttgaaagagaagagcttgttcaagaaatttttaaattaaaagataggcatagagggataattgttaatcagataaacaaacttggggcgtcttatgatcactcaagagaaaggtttactcttgatgagaatctttgtaaggctgttaacaaggtttttaaggacttgtattttaaggggttgatttataggggtgagtatcttgttaatcttgatcctggatctgggagtgttgttagcgatgaagagattgaatacaaagaagttgatggtaagctttattttgttaagtattttattgataactcttcttttattgaggttgcaacaactaggcctgagacaatgtttggggatactgctattgctgttaatcctaatgatgagagatataagtctttagttggcaaagaagttacaattcctttgacaactaaaaagataaaagttattgcagatttttatgttgacagcgcttttggcactggggctttaaaagttactcctgcacacgatcctaatgattttgaaatttcaaaaaggcacaatatttctaaggtcaatattttaactcaagatggaaaacttaataaaaatgttcctttgcaataccaaggattaagtgcgaaagatgcaagatttaaaattgaaacagaattaatggaaaagggttttttgcaagatgttaagaagcataaacaacaggttgggcattgttatcggtcaggtgaggttattgaaccttatttgtctactcagtggtttgtgagaatgaagcctttagcagacaaagctttaaaggctttagagaatggcgaattaaaattttatcctaaaaagtgggaaaatacatataaatattggttatcaaatattagagattggtgtatatcaagacagcttgtttggggacatagaataccggtttggtacaatgttgatacatctgaacttattgttagtgatactgatccttctttagatgaaaagaatatggggaagaggtttgttcaagatccagatgttcttgatacttggttttcttcttggctatggcccttttcttcgcttggatggcccaatgttgatgttgattttaaaaattattatccaacaaataccttgataacagcttacgatataatatttttttgggttgcaagaatggtgatggcaggattagaatttacagggcaagttcctttcaaagatgtttatataacacctcttttgcgtgacaaacaaggtaaaaaaatgtcaaagtctttaggcaatggaatagaccctcttgatattattaatgagtatggaagtgattctttgcggtttactttatcctttttgtctgttcagggtcaagatttaaatattgacgctaaagattttatgtttggggctaaatttgcaaacaaagtttttaatgcttccaaatttattcttttaaatttaaaaaatagaaaaatattaaatgatttgaaatttaacgacattgacaaatggctgcttacaagcttaaattcgactattcttggtgtagagtcttcttttgcaaattataaatataacgaagcttcaaaatttgtttatgagtttttttggaatgatttttgtgattggtatattgaaattagcaaaattgatttaaataatgaaaatgttgatattcaaaatatggctatttctaagttgctattttttcttaaaaaatcattgttaattttgcatccgtttattccttttgttacagaaaaaatttattctgaatttgcagaaaaggaagatattttagctttaaatgaatatccaaattttgatattgccaataattttcaagaagaatttgaaatttttaaagtattgaaaacttttattatagctattagaacacttaagagtgaatttaatatacctgctagtgttgaaattgatgttgctttgaagtttgatgctgattttaaatatgaggcatactttaaggctaatgaaagcattgtaaaaagaatgattaattttaaaaatatattttacaatgaaaattatgatggcatgcttggtgtagctgcagttggttttgaaatttatgcagatgttaagtcattgatagataaaaccaaagagttgataaggcttgaaaagcagcttgaaaagtataaaatgctcaatatttctgtttcaaagaaacttgaaaatgaaaattttttaatgaatgctcccaaggaaattgttgaatctgaaaaattaaaatttgtagaattttcttctttaattaataaaataaataattatattattaatttaaaaaatctgtaaaaagattgaaaaattattatgtaatgaaattggctatggttagcttttcagtaaaatgcttgctttttattagaaatagcacattttgtgctattaattgttaagaagcttgaggagataaaaagcttgaatcttgtagtttcatgaagctgtttattattgttgawacatcttcttctttgatgtaaattgatggaaacgtttttctttgatcaaataggaaattgaaatcaagaattaaataaatttgattattttttcgagttacacttagttttaattcaaaatcatcatcgtctttgtatcgtttatagggattttctttaatcatttttgtctctaataatatgatttcattttctttaatgttttttggtctgctgtcaaataagcttagacttttgattatattactagtatttaaaagattaaaaaagttgaaatttcttctatatccgttttcttttaggataagtttaacttctgaatcgtgatctttaatgtatggtccgttatgttcaatttcaataatgccttcaaggcttgcattatttagaacctcggaatatttctctttttttattagtatatcttgtataaagaacaaatctttgattgtgtcttttgcaaaagcataattattggatattaaaaagattaataccctcacaaacaatttttttgtcattaaaattctccttgtgccatttggaagtatatcatacttgttgggatttttttaacgacttatgttaaaaataaatttttaatttttttgagcttttatcatatgtcttttatttccaaatcctttttctatgtgaatgtatttaaaattagcaagttttaggccatcttttacaattcttgcagaggaaaatgttgaaagcttgcatttcggactgcttttctcagaaattaaattaaatatttcattgctccacatttcaggattttttttgggattaaatccgtctaaaaaccagtattctacattttcaggaatttctttgatttttattttggcgtctccaattaaaatttttaaattaacattttctgttatttttagttttaaatttttttttggaattttagaataatttttcaacattaatttaaaataagcggtttctttagcaaagaactttgaaatttgcattattgtttttttttcgagtggaaatttttctatagaataataattaatttttgaggttatgttgttttcttttatgaattttaaaagacatataaagtttaatcctgttccaaatcccaactctgctattaaaatatttttttttgtttttaattctaaatctaaattgcaacctttaataaatgtataaaaactctcttcaattccctgctttggattgtaatagatgtcatcgaatttgcttgaatatatggtattttctttaaaaattggctttttcatttaattttattttttcaagcttacagaattttgtaagcttgaaatttttaatttgattgatcagaataataagtttttatgtataaatttgtaatttttattaaatatttaataaaaattaaagctaagtagctaaacttagctttttactcttctattattgcaactatttcttttgcttttagtattaaatgttctttattctcgatttttacagcagctcctgcgtatttttcataaagcacagtatcaccaacttttacagtgatctcttctttgttagaaccaacagctataactgtcccaatatttgttttttcttttgcattttctggtatgtaaagtcctgagattgttttactctcagcttctttgatttttattaaaactctatcagctaacggcttaatatttttcatctcaaacatctccttatataataatattaaatatacgaaaaaactgagagttgagtcaatatatttatatggtgcttgaaaattaaattaattttcaagataattttgttattagaatatcaatttaggcagggtaatggtttgataactgtaagtaatttggaagttgcatttggagagagagttttattcaaagatgtaaatattaaattttctcctggaaattgctatggaataattggtgctaatggggcaggaaaaagcacttttttaaaagtattagggggaatgattgaagctagtaagggtgaaatatctatccccaaaaatcaaagagtagcagctcttgaacaagatcaatttgcttatgatggatataaggttatcgatactgttattatgggtcacaaaagactttattctgttcaaaaagaaaaagatgaaatttatagtaagcttgattttactgatgaggatggaattagagctggagagcttgaagcagaattttcagagcttggaggatacgaggctgaatctgatgcagcggttcttcttaaaggtcttggaatagatgaggcaattcataataatttaatgggtgatgttgaaggggctttaaaagttagggttcttttggctcaagcactttttggtgatcccgatgtattacttcttgatgagcctactaataaccttgatctacaatctattaaatggttagaagagtttttaattaattttgaaaatacagttattgttgtatctcacgatagacattttttaaatcaagtttgtactcatattgttgacattgattatggcaagattcaagtgtatcttggaaattatgatttttggtatgaaacaagtcagattttaaacaagcaactaaaagatgctaaaaagcgatctgaagataaaattgctgaacttaagacatttattcaaagattttctagtaatgcatctaagtctaagcaagcaacatcaaggaaaaagttgattgaaaaaataaaggttgaagatttaaagccttcttcaaggaagttcccttatgttaatttcaaaagcgaaagagaacttggcaagaatgttcttacaattaaaaatttaataaaagaatttgaagggaatttaattttaaataaatttagtattattgttgaacctcagcaaaagattgtttttttgggaaatcccatgtttgcaacttttttgtttgatattattacaaatgaagatagaaattataaaggtcattatgaatggggatctaccgttaatttttcgtattttaataaagataatggaaaatattttgatttagatttaaatttagtcgattggttacgtcagtattcaaaagaacaagatgaaacttatattagaggatttttaggtcgaatgcttttcagccaagatgaagctttaaaaaaggtaaatgttctctcagggggagaaaaagtaagatgcatgcttgctaaggctatgcttagcggagctaatgttttaatactggaccaacccacaaatcacttagatcttgaggcaattacatctttaaattccgggcttaaagagtttaaaggagttgttctttttacatcacatgatcatcaatttatagatactgttgctaataggattatagagtttactcctaacggaataattgatcgatatatgactttttctgagtatgttgatgatgctaagattagggatctgagaaataatctttatggcaataatgctggttttaggctttagtagcagttttttagaaactcaaaaggttttttattttgagaggtctacttttcatatttgtgttttcagcttcttttttaaggctttattctgatattaatttatattttcaaaaagcattaactggcaaagttgcaggcaatccaattattgatgaaaaacgtgacactattacagttttaacaaaagatagatggttgactacttatacaatgtcatttgagaagaaatattcttatagattaaatagaatgccatatccttttcttttgaaagattttgataatgggtattatgttattacagttagaaatgaagttcaaaagatcagaagaggaaaactcgtttggaagtataagcttgatttttcacctttgagctctcctgcaataggaaatgttaacatcctaattcctcttgctaatgaaaaggttgtttctattgatttaaatagcggtaaaaaaatgtttgaggttgacataggtggtaggcctgctacttctcctgtagtttttgataatggggatttttgtattgcaagtgaaaatgatgaaatatttttgtttgattctttgggtaataagaaatggtttttcagattagttgctttcccttttttgttaatgataaatacaaaaaaagaggtagttgttggacataagtcagggcatattgttgcttatggaagagattttggggaagttattagctctattaagttggattttcctattaattttttgtttgaaaagtttaatggtgaatatgtcgcaatttcaaatgttggtatgttttttgatttgaatagaaactttaagcttaaatttaaaaaaaaaatgaactttgagattgagaaagctgttctttataataatagaaatcttttaatttcaaccaaatcaaatggaattttgtcttttgaagaggattttgatatatctttttcagatgctaaacttaagggcttgtcaggacttagtgctaattcaggtattattgtcttagggggagatgattgggttcttagtacttattattacgaatacgacagagagcttgatgttagcgtttggaaccattttggaggtaataaatataatcaaggcagaatagatttaaaagaaaagcgttttgtagattatgataaaaattatttacttcttgaagagatccttaattctaattatagtgatgctgcttataataaatttttagagattttagattttcttgcagctgaacatggaaattttcccgcaaaatatttaaatttatatgaaaaagcttttaatgtgtggcttttgtcagaaaagaggtttgatagaattgcttcaagaggcaagctttatagatattttgtatatgttaatgataaagctgcaattaagagttttattaatttggcaattagagagagagatattaataatataattaccatagtcaaaactattactaaatttgaaagttattatgggcaagattgtattatatacaattacatccaaaatatagtgttaaattatcagggtaatttggaaatagcttattctgtgattttaaatttgagaaatataattttaaattcaacagccgaacttcttaaactttgtaagcataagtatataaagttattaatgtttatgaggcgtcaaaatttttctgaaaatattaacaagcacattaatgaaattatttcaagcattcaagatatttcaagtccccaagattgaattagctgttttgcatataaatccgattgtgttaaaattaggtttaaattggtgaatttagttggtaaggtagattataattaaatttataggagaatttcttttatgaaaaaaatgttactaatctttagtttttttcttattttcttgaatggatttcctgttagtgcaagagaagttgatagggaaaaattaaaggactttgttaatatggatcttgagtttgtaaattataaaggcccttatgattctacaaatacatatgaacaaatagtgggtattggggagtttttagcaagaccgttgaccaattccaatagcaactcaagttattatggtaaatattttattaatagatttattgatgatcaagataaaaaagcaagcgttgatgttttttctattggtagtaagtcagagcttgacagtatattgaatttaagaagaattcttacagggtatttaataaagtctttcgattatgacaggtctagtgcagaattaattgctaaggttattacaatatataatgctgtttatagaggagatttggattattataaagggttttatattgaggctgctttaaagtctttaagtaaagaaaatgcaggtctttctagggtttatagtcagtgggctggaaagacacaaatatttattcctcttaaaaaggatattttgtctggaaatattgagtctgacattgatattgacagtttagttacagataaggtggtggcagctcttttaagtgaaaatgaagcaggtgttaactttgcaagagatattacagatattcaaggcgaaactcataaggcagatcaagataaaattgatattgaattagacaatattcatgaaagtgattccaatataacagaaactattgaaaatttaagggatcagcttgaaaaagctacagatgaagagcataaaaaagagattgaaagtcaggttgatgctaaaaagaaacaaaaggaagagctagataaaaaggcaataaatcttgataaagctcagcaaaaattagattctgctgaagataatttagatgttcaaagaaatactgttagagagaaaattcaagaggatattaacgaaattaacaaggaaaagaatttaccaaagcctggtgatgtaagttctcctaaagttgataagcaactacaaataaaagagagcctggaagatttgcaggagcagcttaaagaaactggtgatgaaaatcagaaaagagaaattgaaaagcaaattgaaatcaaaaaaagtgatgaaaagcttttaaaaagtaaagatgataaagcaagtaaagatggtaaagccttggatcttgatcgagaattaaattctaaagcttctagcaaagaaaaaagtaaagccaaggaagaagaaataaccaagggtaagtcacagaaaagcttaggcgatttgaataatgatgaaaatcttatgatgccagaagatcaaaaattacctgaggttaaaaaattagatagcaaaaaagaatttaaacctgtttctgaggttgagaaattagataagattttcaagtctaataacaatgttggagaattatcaccgttagataaatcttcttataaagacattgattcaaaagaggagacagttaataaagatgttaatttgcaaaagactaagcctcaggttaaagaccaagttacttctttgaatgaagatttgactactatgtctatagattccagtagtcctgtatttttagaggttattgatccaattacaaatttaggaactcttcaacttattgatttaaatactggtgttaggcttaaagaaagcactcagcaaggcattcagcggtatggaatttatgaacgtgaaaaagatttggttgttattaaaatggattcaggaaaagctaagcttcagatacttgataaacttgaaaatttaaaagtggtatcagagtctaattttgagattaataaaaattcatctctttatgttgattctaaaatgattttagtagctgttagggataaagatagtagtaatgattggagattggccaaattttctcctaaaaatttagatgagtttattctttcagagaataaaattatgccttttactagcttttctgtgagaaaaaattttatttatttgcaagatgagtttaaaagtctagttattttagatgtaaatactttaaagaaagttaagtaactttacagttagatttaatttgtataaatcgttaaaaaaccaaaaaagctaaaaacaaaagtttttagcttttttaatattttttcgggatggtgggattcgaactcacgatcccctgctcccaaagcaggtgccttagccactaggccacatcccgaatgaagcgcaccaattaggactcgaacctaaaacctacagattagaagtctgttgctctatccaattgagctattggtgcatttaaaattctaatgatgagtatatcattttgaaaaatccttgtcaataaagtctagatacctttactttgtatattttttatttttgttttgtgtttataatgttttataatttttttatgattaatcttgatttgattgttgatgaaactttatttagatatcctgatgttaaaccttttttaaattataaaaacaattatgaacttttaataatggttattttaagtgcaagaacaacagataatttggtgaataaaatttctccatacctttttgaaaggtacgagaattttgaaagtttatcaagagcaaatgtgagagatgttgaaaaattaatttataagactggtttttattcaagaaaggctaaaaatattgtgaattgctctattgatattttagaaaaatttaatggtgttattccaaataatatttttgatcttattaagctacctggagtaggtcgaaaaacggcaaatgttattcttggatctgtttacaataaacccgcaattattgtagatactcattttagtagagttattacaagacatgctctttctttggaaagttctcctattaagattgaattggatctaaaaagaagaataaagccttgtaagcagtatagattttctatggctattaataagcatgcaagagaaatttgtacttctagaaatgtaaattgtgataattgttttttagaaaaatttgctccaagagtttgttaattttttatttaagatgatattaaatgtttcattttttttcttagcttaaaatttataattgctagtattatgtttatgcctattaatatgagtaagggattgatccatatccatagatatttattgcccatttgcatatagttgagcagttctccaagactgggatatagatttttatcttgtttttgtaaaaaacttactacttcaaaagtagtaagacttcttcccatttgtaatgggattatagatgatattgatgagaatacttctggaaaaatatgatacaatattattctaattttgcttgctcccatagcttcgctggctttaatataatctaaattttttattattaatgtattgtttcttgcaataaaagcaaatctaatccatccatgaatcaatgctaatagtgttgctgtttgaagcatattgtaagttttttgttttaaaaagtaataaaaaactaaagacacaacgtaaaaaaaaggtaatgtttgcaatgtttcaattggttttgaaatcagcatgcaaatttcaaaactaaacatgccaatgattgttccaataaagattccaattattgcagaaattgttgcgtagcttagtgaaagtaaaatagagtttctggttgcaattattaatcttgccataatatctcttcccattttgtcgattcctaatgggttgtcttttgtgggtggcataggtacatttttaatagattttaaatagactttatttggatcttttttatagattgcaatttttgaattttcattaaccaatgacggagtaataattagcaacacaataaatatattaaagagtacgatataaattttttttattattgtatctgttttcattagtttagagtgtccttatatgggttaattttgtaaattagtatatctgttattatatttggaataagcataatgaaaacgccaataaaaatcaaatctttagaaatagcataatcgttaaatttcaaagcatttaaatataaggccccaattccatcaatttcaaacattgattcaatcattgatgctccaaaaaaagctgttgtaataataggtctcatgtttgtgagtaatggtgttattgatggaattaatgcatgttttaagattatttgcaatttatttattcctcttgattttgcagcttttatgtaaaattctgataaagttttgtcaagagattgtttaaaaattacagaattaaatatgaagaatgaaaaaaaccatgcaaatccacccattattaaattttttggatttaaattaaggtaatatattaaagacagtattaaaaatactgttaagtttcttggcatggagtggagcaatagcattaaatattctagaatattatttattagattattttttatgtaaattttccaaattataataaggattattgccgcaatataagagagtagggcgcctggaattgagatttttaaagtattaaatattttttgaaaaattattttagtagttggctttcctttgctcagcagagagtatcgatgatcgccccacagcattccttcattttttgttttgtatattatatatgaattgccagctatatgcttcaaaaagcaatctttttctaattttgatttagggttaaagtcatgtatcagggcatatctttctatacttttatatactccaatgtattgtaagtaattttttatgacatttgttttaacaaaaggagtatactgttgttcatttgaaaaaagatttactaacgatacgcaaaaaaatgatgcacaaattaaattaattaataaatatattgtatttttaaaaataaatattttcaataaagactaatccttagagttgttggaagcaagtttattgatttttgtaattttcttggtttggataatgcagcttgataaaaaataataaattaaacctattgctattgatataaggtaaaaattttgattcttggaaaggggtttttgtaaggttaatatttgcccttggttatattgatctttattattgttggtttttattactgttgagttttttgggtagtagcccaattttttagcttcttttagaatttccgatttagatacttgtaggttaatatatcttgcttttaattctttttgaatttcttttagtttttcgatgtgattttttattaatgttaagttgttatccaatttttgataattaacaaatcctctctctccaaatatgggagctattataaagtagcttagtattcctgagtaaaaagacattgcaatttttttataaatagtcatatagcttgtaattatattcttaatatactatatttacaagtagttaaaattgctttagattgtagttttattgagtagttttggagagcaagtttggcatgaaggaaagtgttttttttatcaaagaaggtcccaaggaagttaattttgatattgaaaaggtatttttaagaagtgagtctgttgatattgtttctatagccccagataatcttaaaacttttttggatgaaaagctgttaaaactcgataacatcttaaaagaaaggcacggcgagctgattaattgtttaaagggtgttgagcttcgtgttgagagagttgaaaaagaaatgcttgataatagtcttaagtttgttcaaagggattttatttcttatgattcgaaggattttgaaaaaaaatcatccgagacggatgattcattttcaaaaaaagaagataatttgcctaatatttctattggtcaagaagaattagatgcgctgcttgaaggtatcaattataccccaaaagaaaatgaagaagttcagcacgatgttaaatttaatagagataaagatttgaatttgactaacaatttacatgtggctgataatttttctaataatattcttaaaaaagaggatattaatgttgacagtgataatgtgtccataggaaatatggagttaaataataataacgatcacagtaaaaaattggaaagttttactacagagccagataaactgttagattctgttaataaaaatttggataatagttcttctttggaacatgaagtgggagcagaagatccctattctattgctaattgcgataactctcgaaaattggagagctttgtagataataataaacaacgtttggatttaattaatgagaatgaaaacattgagcatgagaatggtgataattgtgcgattcttaaaagctttggtgaacgttttgagtcaaaagaatttgatgattttgaaaatattttaaaagaggatctggattctacggttgccgaaggctctttttctaatgctggagagaaaaatttgcatgataatttgagagataaatcagatcaagaccaaagtaatgatgttgctaattatgaaaagcccagctctcaaagcataactaaggacccttttccttctaattttaattttaatgatgttgaaaaggttgtaagcaaatttaatgctgaagaatctttaagtaatgttgtgctaaatagcgatgaaaaagccatattaataaattttattgatagggtagaaagtgaacttgagttaaatcctaatagaaatatttttaaaattaaacaagagtatgaagttttaaaaaaagttaaatttttacttactaaaggttgaaaatccattcgtttaagttctattttttataaaaattcttaaaattaatatttgataactgagcggtttgtttgatattaattttaatttaaaagatatatcagtaaagccaaacaacatcttatcttttgataaaatgttgtctttgtcatggtatattttaattatatttatttttatatgtttttcttttaatgctttttatatatagcaagattaatctgcattgttgtgatgttcatgatgatcttcttgattatcgttgctagaaatatcatctttttctgttaattttttttctaagtcgaatacatcaaaaaaagtccatttgctagtcgtgtagtaatattcatctttatcttttttgattaatatgtctttgtcattttcttcgtttttattaaaataaacttcaatattattgacacttttattgctccatttgacttcaattttgtattgaagattataatcatctattttagatttatcaatttcaagtccgtcagctttaaattcagcaataatatttaaaggcctttcttttgtcattttttggttatttaaaaaataaaggccatctttactgataatctcatagttattatttatgttattttcattttccttgtttaattttcttattattttgaatgataaattttctaattttgtgtttttttcttggaacaatgtagtatctgaaaatgtattgtaagaatttcctttgtatgataagaaaatgttttttgttaagtaaacattttcgtcactacctttaatgtatgccagtcttgaatcgccttctcctgattttccaacaaaaatttctgttaacagcttattattattgtcaaataatttaaagcttggattttctccaattcctagttccttgtgttttttttgatctctacttacaagcttgtttttttgaagctcgtctaatgctttgattagagagttgacttttttgttatcaacaggaatattttgtttattgtatgttaaaatccaatctttgccaagttttgttagcgttccttcaagctctgtttcaattttagaaattaaattaaagtcaaaatcaaaaaatttttcttcaaggatccttgctactttattttcatttgaaaaaattattcccaataagaatgtagatgttaacactactattatcaatatttttattttttctttattgattgagaatatttttggttttgtcataaacactcctttgttcttattaatttgcttttctttttctagtaaatctaacaagtccaaatattaatattattgttggaagaataattaagttaacaattattaatgaaaactttgcattgaccatttcgtttgaagagcttgcaaattttaatttagctcgtacctctctggacttaatattaaaaaattcttccttttgcattaaataatccgaaattcttcctgatagttcaaagtttgatggagacccgttgtacatataatcgctaaatatcatgcttgatcctgttaggattattttagaatttttggaatattgatctttataaggacttttaatttttccttcaattgcatatcctagtattttagttttattctcttcaaatttatttggaacttcaaatgcattcaaagatatgtttgaaaggttaggttctttaacttgccatgattgtttggaacttgcaaatagaggtaaaaattttacttctgtttcatctttttttataagttctaatgagctgctccaaggaattgtagcggtataaaaatttttaagcaatggcatgtctttttttacaatattgcttttgtctattaagatccatggatagtaagtttggaaattgccacccaaaaagattgtgggcgctcttttatcaagaataatattatcgttgtattttatcccataactttcaaatagatcaaataggctggatttaataggagttatgccatatggattttgaggattgtagtcaattgtgcttgttgcaacaaatatttttccatcattaacaataaaatcgtcaattttttttgcaatttcttcgtcaatttctttagcgccaataatgaataatccatttatatcttttctaatgtcttctaatttttcagtttttaaatctatttcttttatttcaattccaaatgcttttttcattatttcggaaaagtttttatgtgcttcttttaaagtgctgtctccaaaagcaagtcctaaaacttttttggtattatttattagtttgtcaagtccatttgcaaggtcatattctagattgctgatttctgttacaaccggtattacttctctttttccctcgtaaataatctcaattcctgagtatattttgagtattgaaagctgattaatatctcttaagtcgatttgctgagagggaataccaatgtgctctaatggtgttgaaattttatcagcgtcaatttctttataaattaccttacattttgaagcatcagaaaaacttattaaaaaattttttatttggtttggaaaagcaaaatagttttcaaggcttcctgaattgtaatatgttatatatattgtttcatttgcacttgagaacaaattttttgtaactttagatattgtaaaagctttgtgttttgtaaagtctattttaaaaatgraaatagatatattacaaaaaatcaaaaagattattgtaaggttcaaagttaggtttaaaacttcattttctttgtttttcataaatttatctccatttttttagtgttatgctgtgtgtgcttagtattagaaatgtgactgtgaatgtaataaaataaataaagtctgataagtttaatatacccatattaaaatagctaaagtgattggttattgaaacaaaattaagtatttctcctattatattttcttttccaaagatcataaccaatttcccagaaaatagtattaatatcagtgtaaatacggtaagaatgtaagagactatttggctttttgtaatggaggatataaatgttcccatgcttagcacagaaagagaataaagaattattcctagatattgaagcaatattatcccaagatcaaattcgcccatgaaaattgtcattattgtaagaggtagggtaagtgagaatagtattaaggtaaatattttaagcgtaataaatttgcccaagactatctcttgaggacttagcggtagagcataaagaagttcaatgcttcctgttttgtgttcttctgagaatactcccatgctaagtgctggcagtaccaacattaaaataataggcattgaagagaaataagaggtaagagatgcattgtctttaataaaaaatcctgataaaaaaataaatgaaaagtttatgaatattaaaaaaaatagcatcacaacgtatgcagttggggttccaaataatatttttagttcttttttagaaagcgataaagattgctttaaatctattttcatttttctctctccttggttaatttgctaaatatcttttcaaggctttcatgttttggaatcattgcttttaagattatattattttttactatgtagctaaagagatcttcttctgttttgccttgagatagttttaatgaaatatttaagtctttttcgtgttcttcaagctttattaatgaaaaaatatcatttttgctgttgaaaatttttttctcattttcagatttttttgaaactattaattctatttcaatctctttaagtttatttttaataatattttcttttgtgtcatcagcaacaattactccgttgttgacaataattattcttttacaaatagattctacttcgcttagtatgtgcgaagagaataatattgtactttcttttgcaagttctcttaaaaattctttaaattcaattatttgatttggatcaagaccgtttgttggctcatcaagtattacaagtttaggattgtttattaaagcgccagctattcctactctttgtctaaatccttttgaaagttgagaaatcagcttatcttcaacctcttttaatttgaatatgcttattactctgtcaatttctttttttaattttttaacaccttttatttctgatataaactttaaatattctttaacagaaagctctggataaagagctagtttttcaggaacatatcctatttgctgtagtatttctttcgaatgctctacaatgtcttttccaaaaatttttacattacctttgcttggataatgaaatgatgttaagattttgattaatgtggactttccggctccgtttgggccaagtataccaagtacttcgccttcttcaaccttaaagctaacattaaatagtgctgtaaatggcccatacattttagtaactttttctacatttatcatataccctcctatttaataataaagttatttttgtttgcttcaagcctcattccatctcttgttaaaaaaatttctccgtctggatgttccaattttgcctcctttagtaagttttcaagatcttttcttaatgtatatctttcactaaaatggataagtcctgtttgtaaaacttttgcttgcttgacaatatttgcagccccgccagctgttaagtgaagttttttatcggcttctttttttagctcatttttaaatgtgctctcaattattacaaggttaaaatttttgatttgctgtatgagttctttaaaataaccagtatctgtaatgtatgcaacttttagtccttttttagattttccaagtatttctgatggctttataatttttccgtttaccaatatttcttttccatcttgtagggcttttctaataggccctttaggaatatttagctcttctgctttttctgtgttgaatttgccgggtttatctttttctataaataaatatccaacacattctattgaatgttttagtttagtgtattcaattttttttgttttatcttcatatattattttttcggttttatctatgattatttctttataaattatttcatagtttttatatattttaagcatatttatattagcttgtgtatagttttttattccaacaggtccagcgattattaatggttcttttcttgtttctccactttgtgacattagcattactattccaagtagtcccgtgatgtggtcagcatgtaagtgtgtaatgcaaatcatttttattttttgccaggatattttttgtttccttaaagacatttgggttccttcaccacaatcgaacaaaaagttatctccatcgtattcgattagtacggatgacaaatatctattgtggagtggccttgttcctccagttcctatgatattaatattaaatcccaaagattattctcctggtttgttttgtaagtgtcaattaattttatttgctttgttaaatcttgtttcactcttagtttctctttggataagaattattttagcttaacttaaacattatattatttttttatgaatttagaaatattaatagtagtcgtttgtcagtatgtatggatttaaaaattttgattttaagaatgatccaaaatattgtaatattttgcatatcttttaatattgtaatgatttggaattttgtcaattttttcaatattattaactaataaattagataagtatggagccatagatacgccccttgttccaaaaccatttaatataaagatatttttatgcttaggatgttctcccaagaaaggttctctatcaagagttgaaggccttatatgtgctttttgagcaatgaccttgcattttagatttgttatttttttaaattttttcaatagctctaattttgcccattcatttgtaagtgtattccaagtgttccattcgtaagtgcctccaaggtaaaatttattgccttttaagtgaattaaagatatgtgtctattgtaaatctctttaaagtttaattttttgcattctaatataatgatttcgccttttgcaggctcaaatgggagataagaaaaaaatcctttgagtttttctttatacccttttgcaaatattaatttttcaaatttaaaatcttctattttgaaaaaactttctccaagtttaattttattttcgtttatatttttgcttatgtaagaatttttttcgattaagtattttttaatattttttatatatgtttttgtattaaccctggcgccttttattatcattccgccgttagagtcgtttgagaaattgtaagtttttccatcttgtatttttaaaataaagtttgttatgtttttattattttcaagtttatcaatcagttcatttttttgattttcagtagtaaagggtctaaagatatttttttctataaaaaatttggatttaatggttttttcaatttcttgatagtagttttttgcaaattcaaaaatatgtggttctttccaggcaatgttcatttttctacccataataggattaataagcccgcccgctaccattgttgcttttgtatcttcattatcaaaaagaattacttttttatttcttttaagcagttcgtaagcaacggtgcttcccgctattccccctccgataaccgcaaattcatggtgcattataaactcctttttaattttacttaatttgtaaaatttagagtattttttaactttaatgaagcttgattaaagatttattagtcttttgcttttcagaaattaagtgcaattgtttaatttttgtgcttttttatcatttaaaaaccttttattttcaattataatatatcattatgtttttgtataagggatgttttatgaccgggaaagaagataatgatgcttgtgttttgcatgataaatcattgaagttagttttaaagagcagatcaatagttattgctggtgagattaccaaggatgtttccaggctttttcaggaaaaaatattattgctagaggctctagattttaaaaagcctatatttgtgtatattgattcagaaggaggcgacattgatgctggatttgctatttttaatatgattcgctttgttaagcctaaagtttttacagttggagtagggcttgttgctagcgctgctgctttaatttttttggctgcaaaattagaaaatagattttcactgccctttgccagatatttattgcaccagcccttgagtggatttaagggagttgctacagatattgagatttacactaatgagttaaataaagttaaaaaagaacttaataatattatttcaaaagaaacgggtcaaaaaatttctaaaatagaaaaggatactgatagagatttttggttggatagtagtgctgcaaaaaagtatgggcttgtatttgaagttgttgagacaaagtatcaacttgaagagtttatttccgcttagtgttttatttttttcctgtaatgttgtagatacagattttagtgttttggagtttaaggttgcaaattttaatttaaatgatgatttttctcaagggttacttgattctgcttataatattctaaatcgaagttttgatttaataattattaagaatcttaagaataaaaatgttcttgatttaattaataatagagttttatttagagcttttaagaatgcttattttattgatcaaggtagtggcctttctgttagcattctttctaagcgcaaaataaatattaaagttttaagtgtaatgcaagattcttgcgatttaaaattaggattgcttgtggattttaaatttgagaataatcactatggtattgttatttataatttaagcaaggattttattaaaagtattgccaatttgcaaattagtgaacaaattttatatttaaaagcccaaatggataaattgatgtttattttagatgaatctgaatttgttatttttgatttattaatcaaaaatggattttttagcttaataaatgattcaaactacacttcaatgttagcaaataaaattgattttagagttttttctaatttttttgctagggtttctttatattcatttatgtttgtaattgcagattatttgcatagcaattatgttgttgagaattttcctcaaaaaatagttatcaattgagtttttatatttattttcttatttaacttgacattgcaatatattattatttattatattattctatgccgaagtggtggaattggtagacacacaggacttaaaatcctgaggaggaagctcgtaccggttcaagtccggtcttcggtatttttaaattttttatttatatttctcagccaattttttgtttataaagattcccagtatgaatgatgttcccagagatgtaaaagatgtaaagccgattttaaagttcaattttaatacaattaatatcatttgtagaattgatccaaaaattaagccttttgataaataaataaaattatttaagtgcttatctattattttctttattattaatattgatgtaattattcccattgttgcagcagctgcaaatattgtaataagaataatgttaaattcagacacaataagtattatttctttataaaagccaagcagtaaaagcattgcagatcctgagattcccggtaagatcattgatgctccgcttattgttccagaggatatcaataataagtaatattttattgagtttttgtctttaggtattgtactttgcaattgtatattagattctttgagtattaagaagagtacaataatgctcataccaatgaaaaacaataaattatttaatatttttgtattactatttatttcttttatagatatttctgtttttagtgttagtatatttccaaatgctaatcctatgaaaaatactattagcagtgcttctattattccattgtcaaaagcataagttttaaatatttttgcagttaataatattgaggttaacattcctgttgccaaaatagttaaaaacattaaattttttttaatttctgtgagctttaagatttctgagatggagtttattattttgtaataaatttttaatattaaagccagcgttcccccagaaacccctgggattatgtttgcaattccaagtaaaattcccttgatataaatattaagcatttttatttttaaactttgagtattttaaatttaaatgccttatctgtcatcgccttcgccatttattgttccattttcatgtcgtttttgtattttttttaggtttgtgagggcaacatcttcaagcgtaatgcctaaattattgcttaaacttgacaagtaccataatacgtccccaagctcttttttaattgatattaaatactcatcatcaataatgtaatttttatctcttcccaatttttttattttttcaacaacttctccagtttcaccagcaagaccaagtgttgttaaaattaattcttcttttttatttttgtatttagcagttttttttgctttttcttggtattcgtttagctccatgttgagagacagtttattacagtttgttattatttgcaagtccaaataggatttattttttttatgttttttattatatttgattaattaatcgttaaagaatttatagtatgagtaaaatttttttattatttaatgcaggtttcttttttttaaaaataatttatgttttttcttatccagaaataaaaaatttctcaaggcaagatcctgttttttctgatcttaaaattaaagttttaaaatataacaaaaaacaacatattcctctgtttttttactcatataaagttaaaaaaggggatactttttttaaaattgccaataaaataaatggatggcagtccggcattgctactattaatttattagattctcctgctgtgagtgttgggcaagagattcttattcccagtaaaaaaggagtttttgtttttgatagtaaagattatagatttaataatttgcttttagcaacaagggatcttgctaaagctgaaaaggtaaaaattaaaaggaacgacagagtttatgaattttatttttttgattttgttaagaatccagattttggacttttttcaggcacagaattgctttttttcttaaatgccaattttatttttcctttaaaaaaatttattgttagttctgattttggatttagaaatgaccctttcactggcaacaaaagtttccatacaggaatagatcttgcagctccaatgaatgctgaagtgtattcttcttcttctggaatagttattgaagctggatacaatgatctttatgggaattttgttgtggttggtcacaaaaataatattaaatctctttatgggcatttaaatttatattctgtaaagataggtgattttgttaaatcgggagaatttcttggaanggttgggcaaacgggtcgcgcaactggtcctcatttgcactttgaaatattaaaaaaaaatattcctattaaccctttaaagtttttaaagtaaggtcaggctctgtagccagctaaatatattaaattatcaaattgtattgattattaacaaataatggtgtataattatttgtttgataaaaatatttttacacttttgcgccatgattttaaaagaaagtgtttcattttaatataattattggcattaaaaaattttttggtttcaaaaatatacatggaatttaaagcagtattatttttttgtacccattataatttaataatttaaaataaatcctattaatcaatattatattcgattattttattgtgtaaagtttttcttcctatttttagtatttcggcgcatttgcttttgttgtttttggaatgaaaaagtgtttgttttattatttctttttcagcttcttttaggctaattccnattggtagtgttattttaaatataagattttcattatttttgatttttgctggcaaatcttctttagtgatttgtttgccttttgataatattaatgcactttcaagcacattttttaattctctaatatttcctggccaatcgtaataatagagagctttcattgcatcattagaaagagttttttcttctctattgttttcctttgcgacgtcttttattagtatgtttgttaaataagatatatcatcttttctttctcttaaaggcggtatgtttatattaatgatatttaatctataaaataaatcttctctaaatttttcctttttaatttcctcttcaatgtttttgtttgttgcagccagaagcctgatatcaactttaattgtagcttctcccccaacacgttcaaaagttttgttttgcagtactcttaaaagcttgacttgaatttcaggtgaaatttctgctatctcatcaagaaaaattgtgcctttgtttgcaagttcaaatctgcctttttttttggaaattgctccagtgaatgctcctttttcatggccaaaaagttcactttcaagaatgctttcagaaagtgctgcgcaatttacttttataaatggtttgtcatttctatttgaaagatcaaaaatagcatctgctattatttctttaccaacaccgctttcgcccgttataagaatagatgcatttgattttgctatttttattacaagttcaaaaattttttgcattaatagggattttcccatgattttttcatagtattttagatcttttcttattagtatattttctaaattagcattttcattatcgttattttcttttttatttagtgatctttttattattagcaaaagtctttcaaggtctaagggctttgttaaaaaatcataagcaccctctctcatggcatctacagcagaatcaactgttccgtgggctgttagaataataaaaggtattcccaagtttttttctttaactattttgagcaatttttctccagatatctggggcattctcaggtcagatattattacatcaagattttcattttcaattgtttcaagagcttcttctccgtcactagcagtgaaaacaaaatatccttcatcctcaagataagtagcaattccttctctaatattcttttcatcatcagctacaagtattttgctcattttcaatacccttcaattaaaatattttttttatttagtttaggcagcgtaattgtaaaaatagtgcctttgccctctttgctttccacaaaaatttcacctccaagctcttttattattttataagaaatagtaagtcctattccacttcctttttcttttgtgctaaattgaggcttaaatatttcctcttttaccccatcttttattccgtttccgttatcttttatgttgatatgtattttattgtctttttcgaagagaaaaatttctattttttttatttctttttttgtttcaagcagtgcttcttctgcgtttttaacgatgtttataataacttgttttaatagtttttcatcaatgagaatattgcttattttgtttaaattaagcaatagttttatgtgtttattttctaatccaggatttaacaattcacatacgctgcctattacttgtttaatatctttttcttgtaagttaatttttattggtctgacagttagtaaaaattctgttactattttatctactctgtttatttcttcttttattactttaaaataattttcagctttaccatttttcattttttgtttttcaatttccttttttagcagttgtaaatttatatcgattgctccaagtgggtttttgatttcatgggcaatatttcttgcatgccttgtaaaagaggccaaagcctcaactcttctaaatagttcctctttcttttttttctctttaatgtcttcgattaaaataatgttgccttcaagttttttttcttttacataaggcataaatgagattttaatatatatgccgtttgagattggaacttctaatcctattattttatcttctgttctaactagttcttttattaaatttattaagtttggaatttgaatgtcatcaagaatttctatttttgatttagatgttaaagctaaaatttggtataaaatcttgtttgcatagattatattgttttgtttgtcaagtacaatgattccttcattaattgatgcaaatattccgtcatatatttctatttttttgtaaatttgttcaataaatttagttttttgttcgttagataatttgtttagctttgttaaagcttttttgaaaaaattattcatatctcctcataatttagcattaagttttctattattaattttttattttgattataggggcgatatttgtaaatatttttcaaatgctctgtgtactttagatattgattaatatctattttgttttctaaaaaatcttttctaatgttaattgtaagttcgtttaaaaatattttaaagctttgctcatcttttataaagtcgacttcttcaagattaaatatggattttttttcttttattatatttagaatttttgccaattctttttttatttttttgctttcttctttgtaaaatgaggcgaaatactcttcaattgttatatctttatttattagaaagctttctttaaatctttgaatttctaagcttctgtctagttttgcgaaattgtagactctaagtcttgaaagtattgtttttggtattttgtttttatttcttgctgccaagataaagtaaatatttgagggaggctcttccaatatttttaaaagtgagttatggacattaaatgataaattttcgatttcgtttatgtagattacctttggtttttctttttcagaaaaaatccaagtttgaattttttttacatcataaacagtaatgctatgatttaattctttgtttatattttctatattttttataagctcattttttatgttttcattgtattctttttcataataaacagaattaatgtagttgatatttttttctattttttttaaatttttttcattgctgaaataacatttggtaaaaattacagttttaatatattctaggtatttatttgctatcttttgcgaatttgtagaaagatgtgcttttgcttctactgtgtcaagatttgagaaaatgagcaaattagggtttgttaagttttttccgtttaatattttttttgcaagctcaattgcgctaatcttttttgaagaaaatttttctcctagtaaaagaattgcatttggcagtattttttgatcatattcgtttattatctcttttgcaatttttggaagcattgtcattgctggcccttattttgtttttgaaattttaaagagatagtttattccaggatttaaataatcaagtagtttgctttcttttaggaaatattcaggtttaaatatttgttgtgagtgtattatgtaaaccacgattgcaattattccaaaagcttcaagtaggccaagcactaagcctagtattctattgaagaatagcaatttaagttgacttattattgattctattagggattgtagtattaaaaatcctatatgtataagcaaaaaaaatacaagtagtgcttgaatgtaggatagctcaataataggttcaacaaaccttctaaattcttcagtttttttgtaaagcagtaggattaaaacaaaaacttcagcaaatccgctaatttctttaataaatcctcttaaaaatcctctaaatcccaaagatgtaaaaattattattattaatatgtctactattccagttatttttacaggatcgtttattatcatttagattttgtctccttaatatcttttattagcaatttggctattaaagttgaagaatgcttattattgaattttttgatattttctttgagagagttgattttttctctatcttttaaagttttttttataatttttaaaatatttatatttaaaatttcatcttcatctatataaatgcaggcattttgatttgttagtaattttgcatttttaatttgatctcctctagagccttttttaaatggaatcaaaattgcacatgcaccagcatttgcaaattcctttattgctccagctccggctctgcttattattagattagaaaatttaactatacttgccatttcttctgcgttaaaaaattgccttctaaggtaattcttttcgcttaggtcatttaaatttttccccgattgatggatgaagtagatttcagcatcctttttaatgcagagtgcaaggttgtttaaagcattagcgccaagagatcccccaagtatgctaataattggtttgttagtgttttgtgtcaattgtttgattattttgggatctggatttaaaaattctcttcttataggagatcctgtgtaaataatgtttttgtaatttttgaagtatttttcactttctttaaagcttatgtgtatgttatttgcgaatttagagttaatttttgttgcaagtccgggatctagatccatttcatgggttatgctttttatttttagcaagctggatgcaataattgcaggagttgaaacaaatcctccggttgcgtaaataagctgaggtttatatttttttaaaacgtaaaagctttttattattccaagtattactttgaaaaagtcagtaaaatttttaaaagaaaaatagcgtctaagttttccgcatggaatcgaaataaatttaatattatcttgttcttttattagtttttcttctatagaattttttttacctatccaaaaaaattcaatttcattatcaaattcttttaatttttgtatgatggaaattcctggaaatacgtgacccccagttcctccccctgtaaaaaatattatttttttatttgacatatttttatttactcatgaaaacaataaagcatttactttgtaataaattttttcacattttattttaataatatattgcaatatcagtatttcctttgtaccaagaaattgattcaatcttaaaaattgaatttaatggaatttaaattcaaaatgtattttttaagaaattttcaattcggaccccttctttttttgaaacattttctttaattgactcttttattattaggtgaatagcctttgttgttttttctaaggcttgctctgtttcaaatttttccaaatatcctataagtaagctggtaaataaatctcctgttccactgaaattttgttctaatccttctaaaaaaaactccgagtattctttgtttttaggattgtagcaaatgtttcccaagagatttccccttttaacgcttgtaacaactaccgtcgcttttgtatcaagatttaatattgcttttatgatatcatctttgttgttaagttttgagcttttgcttagcatttcaagttctgtgatattgggtgttattatgtttgcgtactttatgatttttctaaatccactaattattttattatcaaatatagggtaaatttctccatcgtcagcaaacacaggatcaattacaattttttcaaattttattaatttaattattttctctattgttatttgttgtttttcgcttcccagaaatccggtatagagtatgtcaaagtgctcattttgttctttccatatattgataaatttttctaaatgatcggttaaatccactatttcaaattttttataagctgtggaagcagaaaggacagctgtcacaaaaggacaaacttgcatattaaacgaagatattactggtatgcatattgtaagagatgttcttcccatgcttgaaatatcatgcattgctaaaattcttttcattatttttccccctatactggtttttataattttctattcttgaatttgcatcaatttcaattggactttctccatattttaaatacatattaaatccaagtcccgcaatcattgctccattgtctgtgcaaaggtcaagaggagggtagtaagtttgtattttaagcttatctattttttctcttaaatataaattgcttgcaacacctcctgctattaccaatttgttgatttgagtatcttttattgccctttttagtggggtgattagattttcaaaggcagctttttggaagcttgcagctatattattttttgttgttgggttatctttgcttttgaatttttcgagttggtgtatgcaagctgtttttagtccagagtatgaaaaatcataccagttttctttttttttaaaggtggtaactggaaattgaaatgtattttcatctccatttttagatatttgttcgatgtttggacctcccggaaatcccatatcataatgttttgccactttatcaaaagcctctccacaagcatcatctagagttcttccaagtatttcaacatcatcgaaatttttttgtttagcaatcaatgtatgtccaccacttaataataatgatataaatggatattctatttttgagtgcattaaaggggcgtaaagatgacccaagatgtgatcaatgcaaataatgggcttttttaatgaaattgctagacctttggcaaagtttaatccaactattaaagatccaataagtccaggtctagatgttacagctattaagtcaatttcagatattttagtatttgccttttttagtgcttttatacaaacagacataatagcttccgtatgaagtcttgaggcaatctcaggcactatgccgtaatattttttgtgttcggtttgatttaattttatattgcttaaaatatgaattccattttctactacagctacgcaacagtcgtcacaagaggtttctattccaagcactttcatctgattgtttcctcgtaaagatttaataagttgtcgaattcgaattcctggtttaaatcaggtccttcttttttaaggacttttagcgtatttttagaccaaatgtgtcctattacttttaccattccattttttctagcaatattttttgctttttcaagctcctttgttacggactcttctgtgtctttgctatcaagaaatacgtctcttttttctactttaactccaatttctttgcctattatttctggtacgcttcctgcaatagttacgctgtcgaaaaaatatctgtcaatctctttaagcttttctaaaatgattttcatcaaatctttatttgaagtgattaaacttcccatatggttattcattatttttgcatcaggatactttttaaatgctttttcgatttttttgtgtatttcttcttttttatcttttatgtttatatgaaatttttctattgaatttctatgttttgattgcattgggaaatgtattattactgttttgttagcattttttagttttttgtataaactcattgattttggtaaaaatggaataatagcataagttattttaagattaagttttataaattgttctaacataaattcatcatagcccacgtcgtcaatgattaagtaaaacttaggtttgcttttggcttttttatcctcgttgttgttttttattattaagctttctttttgtgttttttcaaacctatttttaagtggggcatttgcaatttttgaattgtcattaaaatataaaaaacttgcaaatgcctgagttattgcaataacaatagaaattataataaaaattacaataataaacttgttttttttaatataaaatacaaacattcatgaccactgacttacaagtagaccagaacatgtcatgaatgtcaatgttaatttatttcttcttttaattttttaagaactcttttttcaatctgtcttacagtttctgatgatattccaagttctgttgaaatatcttttaaggtgctttttttgggactattgtccaggttatatctttttttaattatgtatctttccttttcatttaattttgtttcaagtatataattcaaatgttttagagttgaatcttgttcaagggtaatttcagggttaaaagaattatcctcgtatagattcaagagtgttgaattttcagatccctctatttctttgtccagagaatattctttttcaagatagggaataatttttatatactgagcaggagataggttgaatcttttcattatttcttcttttttgggcgatttttcttcttctgttaaatatttatttatttgtagtattagattttcttttctgtatgggacttttaccaatctggttttagtgtttaatgctctttgtagtgattgcttaatccaaaatgatgcataagttgaaaatttggtatttttattcgggtcatatttttcagcagctcttattaatcccaagttgccttcttgaattaagtcttcaatttttaaccctttacccgcatatctttttattatttttaaaacaagtcgcaagtttgcatttatcatcttgttttttgcttttgcattgcctctttgtatttgtcctgcaagtttgatttcttcttcgtgagtaattagcttgtgttctcttactgattttaaatatatgtttaaatcctcattactaaatatgttcatagttattatattttctcccctttcttgaatattgtgattaagtttttactacttaatttccatgcaaaaactgtgccaatttaatttaaaaatggttttaaactaaataggatataattttgagtttagggggagtattttttgaattatttacttttttgtaattgattgtaaattaaatcggcaaggccaaagctttgagcttgtgccatttgttttgctctttgttcgcaaagcatatcttcaaaaatttcttctacttggcctccgtttagcaaattttgatctttgttaagagtttttttcatgctttcaagcatttgcttgataaacatagcttcaaattctaaagaagcttttcgaagatcttcgtttttttgaaaggatttttttatttctacagaatttttaaaattatttatttgatttttaaattttagattttgtgaattaattttggtttccatcaatttcctccaagataagttccccatttaatttattaattttttgcgcagcttgaattatttgaattaattctttattgctaagattgttggaattttttaatataaattcatttaatttcattgagtttacttgaattgttgttttgttatttttacttaaaaaaatgttttgattgtctttttcaatggaaaatgtaaaagttcctatttttgcattttcacttgctaaaataataccattttttttgtctattaatatcttggggttggtttctattttaatattttcaatctcttctaataggcttatgttttttgcttctatttctattgtgctgtctgatttaattttgttgttgatttttttagaggttaatattttatgaattctatttattaatgtataatttccttttttaagaattatattataactgtggttaatattttgattctcatttattattacactatctatagtatatccagatccttttaatttattattgggctgtgtaattcctgatgcaattgctattatttccccctctttatttttaagatttgtttttaaaagtattccatttgttaaatcttttgagtccagtattgatgcaacgcaagctttatgttttgaacctttgattgtattaccttttacttggagactgacatttactagtgcaatatttttactttctatgttattagagcctatttcatttattatattgttttcttctaaaattttaattataaggtctttttgttttatagagtctccttttccagcaagtcccgctactattccaatacctgttaaaaaatttgtatttgtgggataaatatccgcaatttcttttaattttacgctttcagataggctattgttaaatgattgatctgtttttagtcctgttgaagctttgtttgtttgggctaatagactcgttgcaaatgtaattaacatcaacattagtttgttcattctttaccttatttattgtatttctttaatatctattattttatatcaattattgcaattaatgaaacttttttcgttaaattactaattaatccttgatttgttaaatattagctgcattaagggagattaaaataataatttttagaaaaggaagataaaattaggtattattctttttgcaccttatttaatcttatctcttcatttttgattgtgttgcgtataactttgtatttgctattgtttaattcatttagacttaaaacatcatttattcttgttgtgttaattttgtatttaaagtatgtattgtactcattaaggatttcatttttttttagattttcttttgcaaatacaattggctcgattacatcaatgtacatattgatgtaattgtgtcttttgtagctttcaaagttttttgcataataaacaagagttttttcaattggaatatttttgtatgaattgttgctttttaccttaaattttacttttttgaaaaatttatcttctatgtttatttcagattcatcaaagttaaattgaagtatatagatattttcatttgataaattttttgtaatgtaataaatcatttcaaaaattattgatttttttgttaaatgtggggggatatatatttttgataagctttgattgttacatatttttgaatacttctttgaaaagaaatatgttttactaggcgcaatgttgaaacataaatcatgagaagctcttataattgagcttgttgtgaaaaataaaataaaaataaataatcttttttttattttattgcctttttaagttatttgcaattcctaacatattgtcagaagtttgaatagcttttgagtttatttcataagccctttgagctactatcattgttaccatttcttcagcaatagatacatttgacatttcaagtatgccttgccttagtcttcccatgccttcacttcctggtattcctgctatttcttggcctgatccagctgtttctttaaataaattgcttccaatggcacttagtcctgcaggattgataaatcttgatatttcaatttgcccaagctctattggttcgttgctggtatcaatttttaccgatactattccctcttcagatattgtaattgagttttggatatattcttctgggaagagtatattaggcaatactttgtatccttggcttgttacaagctctcgattagaatcgattttaaatgacccatctctagtatatgcataagttccatcaggtagaagaattttgtaaaatccatctccttcaatggcaacgtcagtgagtaaatttgtggattgcatttttccttgttcaaatattctctgggtggcagcaatttttgttccgtgaccaacttgatttccaagtggtcttaaagtattttcagttgcaggggttcctgctctgttatgggtttgataaattagatcctcaaattctgctcttatttttttaaatcctgtagtatttacatttgaaaggttattggcaattgtatctacattgtattgttgtgcagtcattccacttgctgctgtccataatgctctcatcataaaacatgctccttaatattttccaatttcatttattaattttcccaatagactatcttcagtctgtattgttttttgattagcttcataagctctgttaatttcaatcattaaaaccatttctttaacagcattaacattggaagcctcaagtgtttctgtttctattttaggccttaatgatatatcaatttcttgtgctttgccagatgtttttgtatcgatccataaagaatttccctgttttttgagaaatctgggattttcaaaatttacaattctaatggtatcaagcagctcataattttcccaagaattttcatactcgctaacaagtcttttggggtctgattcaaagtttgaattgtgaaagacttgtccttgaggtgttattttaaaattatttttcttaagatatatgtatcctttttctcctagaacgggaaatccgctttttgtaacaaggattccttcttttccaatagtaaaagaaccgtttcttgtatatctttctccatctgaagtttgtattacgaaaaatccttgatcggtgagtgctaaatctaatggattgccagtagtttttaatgggccctgttcaaatactgtgtatatctcattttcttcaacccctgttcctattttgcccacaaccggagctgtttcaagatgtcctttgggaaatttataaagaccatcatcatttagtcttcttattagcatttctggaaatgctttttgaatagacaaatcttttttgtatccaataagatctatgtttgccaaattatttgacacggtatcaagcttgcgcctttctgccatcattccgctggcagctgtataaattcctcttaccacggttaaatccttaaagacaattaactttattaatattagcattaattgtcccatataacaattaattggcctgttgtgtttttgcttaattttatatttttttgtctaggtttttatcttaataattaaaattataaaataagttgtataatgatgtttgtggctaatttttaaattagctgccttacatgagtaatttaaaaaaagagctataatttggttttaaggaggattgatgactagagttttttcaaagttttttctttttttttgtttttcaatgcttttatttgcaaattcagaagattcaaatgaaaaggacattgttagcaaggatgaaaaccctgtttttgaaaatgaagttttaggatattgggttggttataatgatgtaagtaacataaagaattctattatctatatttataaatataatggggaagtttatggccgaattttaactataataaaagatggcaaaaagtatgatgctaaaaatccttcaggagatactgtagttgggtttgaaaatcttgcaatagagggtcttgattttatgtggggtcttaagtattcttcttcttctaaaaagtgggataggggcaaaataatagatcctaaaaacggtaaaatttataattctgagatgcgtgttgatagtaaaaccggaaatcttattaccaaggggaaagtttggatttttggtagaagtaaaatttggacaagagctaaagatgatgaaataccaaaattagatttgcataatcttgttccagcgccccctgtgaaaaaataaatttggcttttggtcttgatatttgaaaaatatataaacatatagatgggataagtaggttatgaaaaataagacagagtattatgatcagtttatttcaaaaatacccaattttcctaaaaagggtgttcttttttatgatattactagcgttttgctaaaacccgaagtttatagttcattaataaatgaagtatattctttttataattttaaaaagatcgattgcattgcagttgttgagtctaggggatatttaataggtgctcctttgtctttaaaaatgcagctaccccttgttttaattcgaaaagagggtaaattgcccagagaggtttttagtgaagagtatgagcttgaatatggttttgggagaatagaggtgcacaaagacgatgttaggacgtattccaatattcttttaatagatgacatattagctaccggtggaactttaaagtcgtctgcaattttgctagagagagccgggggcaaggttaaggatattttttgttttattgagctttgcgctattaatggtagacaaagtcttgaaagttatgaagtcaattcccttgtaaggtataattaatttaatgcttgacttttcttttttattaaatttacaatgtttagttgaggtaatatatgtatgcactggtagaaataaatggcaagcaatataaggctattgagggtgaatttttaaaaatagacaaaatttctcctgttgaaaaagataagttggaatttaatagtgttttgcttattaataaagacggagaggttaaaataggaaagccttatgtcgtaaattctcttattagatgtacctataaagaagataaaaaagataaaaaggttgtttcttacagatacagaagaagaaaatcaagtgagagaaaagttgggcacaggcaaacctattcttatattttggttgatgaaatagttttttaagtatattgattaatgttttggtaaaagtaaaagacgatgtaattatttatcttttagccaatggtcatgctataggtaagaataatgttaacgttgtctgttcttctttttcttttattttgagaaccttttttagtgttcttgatcttgagggtgaggcttttgttgtgaaaaattcaaaaagaggttatttagaatttaagcccttttttaaggatttgaacaaagaaagtcttttttactatagtaggtttttaattagaggcataaatgatttgtgctttgagtatcctaatgatattaaattagttttggaggaaaattaatggcaacaagtaaaagtggtggtagttcaaaaaatggacgagattctatatccaagcgacttggagttaaaagaagtggtggtcagtttgttaaagctggagagataattgttagacaaagaggtacaaagtttcataaaggtaaaaacgttggtcttggaagagattatacaatatttgcgctttcatctggtaaggtagagtttaaaactttaaaggggcgaaaatacgtaagtattgtttagttttaattgaaaagattggagatttttggttttaattgaaaaattggagaaagtttgtataactttaaggactctgtaaatataacggtagtttcgggcaatggtggttctgggtgtgtttcttttttaagagaaaagtttaatgcaaaaggtggtccagatggcggaaacggtgggagtggtgggagtgtaattttcaaggtgagggaaaatcttagcactttatctttttacaaaaatggtcatgtgctttgtgctgaaaatggtaaacctggaatgggttttaaaagaagtggtgctaatggtaaagatttaactctttttgttcctccaaatacagaagtttataatgaaaatgatggaactcttttgtataggcttaaaaatttaaatgacgaatttgttgttttaaaaggtggcagagggggtcttggtaattggaattttaaaacttcagttagaagggttccaaggtttgctcaacctggagaatcgggtaatagtttgagcgtgcgtcttgaactttttttggtggcggatattgggcttgttggattacccaatgctggtaaatcttctcttcttaataggataacctcagcaaaatctagggtcgcaaattatccttttacaacaaagattcctcatcttggtatgctcaggcgttcttatgatgatttgattattgcagatattcccggaataattaaaggtgctagttttggagtagggctcgggactaaatttttaaagcatattgctaaaactaaaattttagctttggttattgatatttctgaagcaaattttttggagtcatataacattcttttaaatgaattaaaatcttatagccataagctttttaataaaaaaaaaattattattgccaacaagcttgatttggacggttctgagaaaaattttgattgcctgataaaagccttaggaaaagaaaaggttgttggcatctctatttatgagaatagaggaattgatgaacttattaaagaattttttattttggctaaaactttttaataaaattgatttttattgtgggctttttatttttaagacttggtttttggatatcagattttatttaggaaagaaatcgtgagaattgcaatattagggggcacttataatccagttcatattggacatatttttttggctaaagaaatagagtatttattaaatattgatagagtaatatttattcctacttgcaatccagctcataaattgattgatgagaatgttagtgttagcaatagaatagatatgctcaagcttgcattagagaatgaagataaaatgttcatagatgattgcgacataataaatggtggtataacttatactgttgatactatttcttgtgttaaaaaaaaatacaaaaacgataaactttttttaattattggcgatgatctttttcaaaattttgattcatggaaagatcctcaaagtattgtaagttctgttgaacttgttgttgctcatagaatctacaaagagagacttaaaagttcttttaagcatatttatatagataataaaataataccgatttcctcatcagagattagaaatagaattgtaaatggattgcccgtcagctatttattgccttttggtgtgttaaaatacattaaagataataatttatatgttaaaaaggtaaatgtttgagaaaggatttaatttttttatttttaattgttttaataatagcaagtgtagtaattttttttattagaagttcgaaaaaagagttggtttacttcgagcttaatacaaagagtaatattagttttttgtttctaatagaagatcttaacaaaaaccttgtaagtatgcaagaaatttttattaatatgaaaacaggaaatattgggttttttgatattccaattcatactggatatgaagatttaaaagggaatatatcttggtttaaagatctttataaaaaaaattcttttaataaatttttatctaaaatttatacacaattatctcatgaatcagattattatattcgttttcaaaaagaaaattttgttaggcttattgattacttagggggagttagacttcttgttaaaaacccagtgaaagtttatagtttcgaggattctattttaataccctctggcacttctaattttgatggtgataaggcttatgattatttgagatattttaatgatgttaatcagtttgaagagagagttgaattttttaaagaattttttaaaagacttctttttcaaatttcagattttggcattgaaaatgacagtttttttaaaatatattccatgttagatactaacctttcagaggttgtttttaagtatattgttaaaaattataaaataaataatgataaaattatttctattaatattaaaggacaagaagagatttttaaggataatgataataatttgataaaggtggtttttccttattatgggggtgctattttaaaagaatcggtggataaattaaacaaagagttggttaatgaaggtgcagaagagatagtaaagattgttgttttaaatggaacaaaagttgttgggcttgcaaaaaaaacagcaaatatttttaattctttaaaatttaaagttttaaaatttggtaatgcagataaaaattcttataaaaataccctgattataaataattcggataatttagaaatggctgttagggttggagaggtaattaaaacttcaaatattaagccaatttctgaggttcaagctaaaagattgttagagcttgataatcttgatattaatcctgatgtaatagttattttaggagatgattttgatggaaggtatgttaaaagtaaatgatattaatgatttatgtaaaataataagtgattttaatggaattgatgttataggcattaatgttagcgatatttgtaattggactgatttttttataatagccacttttgtatcatttaagcaaatggaagctttatatattgacaagataattaaattctttaaagaaaaaaaaattaatcttaatgctgaaggaaaagggttggtttatgactggactgttgtttctggtgcaaatttggtaattcatttaatgagtgaaaaatctagggaatactatgagcttgaaaaaatatggtccaaaggaaccattatttatccctaattacttagtttaattaaaattaattaaaaaaactaaaaatatcataaaaacgtgtttacaaaaaatagaaaatattttagatttaagttatgtactttttgcgggaggcttataagtggatattacagacataaggattaagaaagttgatagtaaaaattctggttctaaattattagcatatgttgcagttacttttgataactgtttggttcttcacaatattagagttattaaagggcaaaagggagtatttattgcgatgcctaacagaagaactagagtcggtgaatataaagacattgtacatcctattagtcaggattttagaaaagctttgcaaacttctatttttaaggaatatataagagaaaatccagccgatcttgaacttgaattagatttttagataattgttgacaaagctcgttgtatcttgtatgcttgtcaattgtaagtattaataaggtatttgggacgtcgacaagtggtaagtcaactggttttggtccagtcattcgagggttcgaatccttccgtcccagtattttacattaggagttttttggtggaaaatagcagggttttaagttgccaatatagatcaagctttggatcttctaatgctcgcagaataagagctaagtctgaaataccagctgttgtttacgggcaaggtaaggatgtttcacacttgagaattaagagtagtgaatttaataagaaatttgcaaaatttacggataatactgtcttaatattagatgatggcaagcttgaaagatgtgtttttgttaaagatgctgcagaaaatattgccagcaagctcatttatcatattgatttttacgaagtagataggaatgttgagcttgaaaaatatgttcctattaagcttattggagcttctattggggttaaagaaggtggaattttgactgttttaaaagagcaggttaaggtaaggtctttgcccttggatttgccagaattcatagagcttgatttaactcctgttaataaaggagatagcgttcttcttaaagatcttgtgttgccttctaatgttaggcttgcagaaaatgacgagaatttggaagttgttattataaagtgattttatggggttgttgatacttggattaggaaaccctggattagaattttctttaactaggcataatgttggtttttctcttttggataaaattgtttctaaaaacggcctttttttaaagagaaaaaaaaagtatgaatattcagaattaaaaatgatttccggaagagtaattttggttaagccattgacctatatgaatctaagtggctctctatttccttcaatattttcagatttttatatgtgtataaagaatttattagtggttcttgacaatgttgatcttcccctgggaaaatgcaggcttaaagagcgaggtggtgtgtctactcataatggtcttagatcgatttcaagtgttcttggaagctctaactatagtagactttatattggggttggaagcaatcttatgcgtgatataaagagttttgttctttctagattttgcaaggatgaaatggatagacttgaaaaattgtatgattttttaagtgatgagctgattgatattagcgaagcaaattttaaaaataaggttcaaaaaattaattctagtaatttttaatgcattttttagacgaaaatatacaaattaaaatagataaattttataaaaaaaattctttagataaaaatcgggttattgttgctttttctggcggggctgattctacggctttattattgaatttaaaatattacctgagcaataatgttattgcattttattttgctcattttattagatctgataatgagcaaaatcaagagatagagcatgtaaaggggttttgcgatctttacaatattgctttacaaattaaaaaatgtgatatagatataaaaagtgaatcagctaggttgggagtatctattgaggagcttgcaaggaaatttagatatattgctttagaaaatgctcttaaagaaaatggcgcaaattatattgcacttgctcataacgaaaacgatcaaattgaaacaataattatgagattttttcaaggatcttttttggatggtctttcaggtattcctagtgtcaatagaaacattataaggcccttgcttgaggtttcaagactagaaattgaaaattttttatctttgaataatattgggttttttgttgatagtacaaatgctcaaaatttatatctaagaaatagggttagaaataatttgctacccgctataaaaaaggtttttaaaggatatgaaaaatgtcttaaaagaatatctgaattttcaaaggaatttgcggattattttggaaaagatgaattttttcctgttgagaaaggtaaatattattattcttttgatctgaaaactttcttagattttcctaagtatttggtatttagattgatttttaaaattttaaattcagaaggaattgcagccaaagtttcttataaagctcttaatgaagcgtttaaagtagagattaataggaaaaaaaataatgttttgttaaaaaccaatgatttttttttagaaaaaaggcataataaaattaatttaatttttaaaagggatgaaaaattttacaaaccttttgattttattttggaagttggtaaatggcatagtttatctttaggtaagattttgctaaaatatttagagtgtaatgcagcttctgtatcaagattaaaatgttgttcttatgagtttaggtataaattttttaaggatagattgaaagcaaaaaaatttttttctaagtttataaggtgtaatccggcttatttaatgttgttagcattagataacaggttaattgggattattgatttaaatactttaaacttagtatggagtgaaaaaagcattcttaaaaaaattaatatatctttgattggagggcttttaaaggaatgaatggcaataataatatgaataacaatggaaaatctaacaacaaaaaaaagaataaaaattggattttaggacttgttgttgtttttctaatttcagcaatatttatgtcatattttataagggggggggaaagctataaaaatgttccttatagcacttttcagagttatttagacaatggtctagttgagtctgtagtaataattgataaaaatttgattcaatttgtcgtcaagggttctaactttgcaaagtcttatttttctaccagcattccctatcttgatataaatttactttcagaactaaaaaataaaaaagttgagcttagctcagggaaaagtcaagcttctctgattggggttttattacaaactttgccatggattttgttttttattttctttttctttatatttcgtcaaactcaaggtggcggtgggaaggtttttacatttgggaaaagtaatgctcaaaagtatgaagctggaaagaataaaatcacctttaaagatgtggctggtcaagaagaggttaagcaagagcttcgagaagttgtcgaatttcttaaaaatccaaaaaaatttgaaaaaataggtgcaaaaatccccaaaggagtgcttttagtgggctctccgggtactggcaagactttgcttgccaaagccgttgccggtgaggctggggttagtttctttcacatgtcaggctcagattttgttgaaatgtttgttggggttggagcaagtcgtgttagagatttatttgataatgctagaaaaaattctccatgtattatttttattgatgagcttgatgctgttggtcgaagtcgtggtgcggggcttggcggtggtcatgatgaaagagagcaaactcttaatcagctgttagttgaaatggatggatttggaacgcataccaatgtaattgttatggccgctacaaatcgtcccgatgttcttgactctgctttgcttaggcctggacgatttgacaggcaagtaacagtttctttgcctgatattaaggaaagagaggcaatattaaatattcattctttaaaaacgaagctttcaaaagatattaatttacaagtaatagcaagagctactcctggagctagtggtgctgatcttgcaaatttaattaatgaaggagccttaatagctgcaaggaataatcaagatgaaattttaatgaaggatatggaagaagccagagataaaatattgatgggagttgcaaaaaaatccatgactattactgataggcaaaagcttgagacggcttatcatgaggcaggccatgctttgcttcactattatcttgaacatgctgatccacttcacaaagttaccattattccaaggggcagggcacttggtgttgcattttctcttccaagggaagatagactttcaataaacaaacaccaaattcttgacaaaataaagatatgctatggtggttatgctagcgagcaaataaatttgggtgttacaacagcgggtgttcaaaatgatttaatgcaagctactagtttggctaaaaaaatggttacggagtggggaatgggtgaagaagttggtccaatatttttagtagacgatgaagcacctattttccttccgaaagagttttcaaaggctaaagcttattctgagaacactgccgataaagttgacagagaggtaaaaagaatacttgaagaatgtttaaaagaggcatcggatattcttttaaagcataaggatcaacttgttaagcttgcaaaagaacttgttttaaaagaaactttgacagacaaagaagtgagagagcttttgggttttgaagctaataaggatgaatacgatttattttcatcagactctactacaaaagaagtaaagggggaggatgtaaaaggttaggcaagtgtttatgttttatttgaagatgggtttcattctttttatttctataaacctatatgcaatttcagtcaaagaagatgaagatatttcaagtattcttttcaatgagtctaaaaatttttccaatttacaaaaaggaaatgatttaatttatggatctcttgatttcaatttgctagcttcagatgctctttatgagctttcattaaaagagaatgttgctttaacggataaaatttatttattaaaagaagcaattaatattaataactttaaagcagtaacccttaaagaagtatacacttattatttttcgttgcttttaagacaaaatgaaaataagaatatgtatgaagaaattattactttgtatagaaacttgaatgaagaattgcaaatagacaaagatttaatttgcatgaggcttgaagcttctggaagacttgaaagttttggagatgatttcaaaaaaattttatttaaggctttttctttatatggtaatgattttttattttttaaatggtttttaaaagaagataggtttttttttagcatctttaatactattagatcaaaagaagattttttctttacaaccgaaaacattaattatatatttagaaattcaaattttaattatgacaattctgtttctttgttttcttttcttaagggcaaaattaaagaatataatggaattcacggtatttattttttaaaatacaaacttttagatcctgatgaagcttataggatttttaaaaaatttcctcctgagacaataaatgaatataaaatgttttatgatcttttagaggatcccgacatgaagagtaaatttttagaagattataaaagtttgtcaggaatttattgcattgataataaaaataatgttgccatactaaaagatggagttttagtaggcattttttcaggaatagtagattttgacagcaaatttagtttaaatagcaaatattttaataaaatttattttaaagataagtctccagtttattatgagaatagtttgcttggttataaaataaattattctgtttatccttatgttgatatgattgaggttcaatatcctgataaaagagatgtttatacctttgctttacatgcttttaagtttaatctttttaacaatttgggctgcaattttaatagttttgggatcagagagttgttcttgattgatattagggatttttttattccaaatgctttaaatttattttttgaaaaaacttctgttttggatattagatcaagcttgataagtaaaaaaaaatattttggatctaatttggtagaaattaaaaattatgtggttggaagtttggtttcaatttataaaaaagttaatagttctaaaaaatttaattatattgaaatttatgagaagaataaactaaaaataaagaaagctttgttagatgatgatagttttgaaagctattattcttttgaataatagctttaataagatcctaaattattaatttttaggcttttaatgttaatgttttttgttgtttttatttatataattgaatttgatttactttagggaggatttttgggtttttgtttagactttgctaataaagaagatactaaattaaataacattgtctctgttagtcattttgattttagggtaaaaataaacttaattcttgtagttggacccatgggaagtggaaaaacagaatatgctgcaaaaatttataaagattcgcttgttgtaagaaaaaaatctttcaaggtattgggcaatattattaaaggaaatagaagtagggttaatgtattttttattagaaattttctcgacaagaggaggtttcaagattatccagaaaacgtaataccatatagaggcggtggaaaagataaaattgatgagattggttatgctagcaactcttttgatattgaaaatttaatagcctctaatcctagttgtggcacttttattattgatgaggcatgtttttatgatgaacgtttaatttttgttttaaataaaatttcatcaaatgagaatattttatttatattacctacactgctttataattttagaaaagaatctttcaatgatactgccaaacttttagtagaatattcagataagatttataagcttggagcttattgtgggcacattgattgcatggaagaatcttttttttcgtataggtattatttttacaacaataaagaaattccagctccttattttgatcctttgcttattgttggtggcgatgaagagattgaatctgctatttacccaaattactctacaagatgttcaatgcaccattatcttataggtaaggaatattttttttcttttttaaagccatttgctttgctatattcacaaggagataaaaaatttcttgaaaatgaaattgtagcactaagcactgatgttgaaaattctaattttgtaaattctttagatagtgaaaaagcgcgtgaatttagagccgaaattttaagaaatattttagaattgccttttttagcagaaagagccttaataactcttttctcagaatatagtattttgagtaaggataattttaaagatcttgtttttaagttttctttaaataaggattatataaataaaatttttttttccaaagagggcaaagagtttttttaataatagtttggcccttgttcaaaaaatgctttagtttcgtcaattcttagtagttcttttttaataatgtcatagtaattaagctctttaagagaaattttatgatattcatcttcccagtttgttattccatcgttttctagtttaacagttgtgtaattttcaagttttttgtggtattttagtgcttcgctgtagtaattaatagctagtttatataatttttttgatttttctagattggaaataattccatctttttctggagttttgaaaaaatataaatttcttgtgtcgaataaatctcctaaatgtaaattttgcctaactagaagcaagtttacatgcattttgaaaagaagtttatatttttcccactgttctttggtttctattttagttagagaatattttggatttccaaatgggtattttaaggctttttgaagaaaaaatatattttttttatagttttcaggtttttttttcatttgagaattaaaaattacataccattgttctgcgtaataaaatttggacgatgcatttatctttgcaactgatactaaaagaaataaaattaaatttatttggaaggggacatttttgaaaatatgcatatgattaattatattagaattttattagattgaaaattttttttgcgtttttatctaaattatcttttattgaattgttgatgtaaatcacattaatttttttttctagttttttaaatatttttaaatattttagagcaatttgttcaaaagttttatatttttcaagttcaaaaagatcactttgtgttctatttttctgtattctttcataagctatgtttgggtctgtttcgataaagaatactttttcaggcaatgggaaatttttatttaattcatatcctaattttccttgatatgcaatcgatgagaataaatagcgatcagttattatttttctagattttgtgtttaaaatttccagtattccaccttttttatataaatgatcgtgtcggtctgcagcataaagatatgcaaatgttgattcttctaaaggattttcaaaattcattaattgctttcttatcatttctccaattattccacttgatggttcttttgtaaaataataccttgattcatcgttgcaaagagcttttagtttattagtgatgcttgttttcccgcttccatcaattccttctatgcaataaaagtttttcaatattttaatcacaaatattttttcttcctttcttttggtgtcaataattaggttatcgataattattatataataataattatcgatagagtgtatgaatttgttgtttttgagaagtaagacatttatattgttgattttgccattttttatttttgttttaataattttttccattaatctatttgttcaagctcaaatttattctgcaaagttttttgctataaaatatcttgaatcaaaatttggctttaagattaaatatgataaaatttcaccgtatttcttatcatcaatcaagatagacggtttagagttaagcttggatggaaaagataaaatattaatagatattgttaggatagatttaaatctgtttaaattaattttgggtgatgaaaatattattttaaatgtttatgttaaaggaagtaatttcaattttgatataaacgactttagtttatctggcgatttaaatcctagcaatgcctattctgacaatgaaaatacagtttttaataaaattttaaactacctttatagattaaatattaatttagaaaatatcaatattaatatcaagcttaatgataatagttggcttaattttcaagttaaaaatttttccttaagtaccgtagatgaagattttttatttagctctgtagttgattttagtgctgttaaaaatttagaaattaatttaccctttgaaagagttgatgatggaattttggattcaactttctattttgaggggaaattcaaaaaaggctttgaagatggctatgttaattttagcttttttgaatttaaaacaagttatttttctttacttgagcaggggttccaaataaattattcaaaaggaaatttaaaaatttttaatttacgaagagagaattttgattttaatttaagttatgacaaggctaatggttttgttcgattagatgctttatttttcaatgttagtcttttagattggattaagctaaacaaaggctttgaaatttataaagattattttgatataagtttaaatgggcaattggcattttcttatgattttaaggacaaagatttaagatatgcaggaataatagattcatctttaaatgtagatactataggaaaagaagttcaaggcttgcagcttgaaatcaagggggatgatagaattgtaagtgttaagaatgcttttttaaagcttaaaaggggggttgtaaactataaaggttattattctttgaaagatttgcttccaatgggacgtcttaactttaagtctgcaaaaattttaaactttaacgacctaaatgggtatttagattttaataaagataaagatattttttcggttaagtctgataattttagtcttggaaatcttagttttcaaaatttaattttaaaaacttattttttaaaggataaaatttttgttgactatttgatttatttagaaaataaaaactctcaaatttctttaaaaggagatcttaatgatgaagaattttctttaagcttaggtattaaagaatttcctttgctttttttaaaagaagttattcccagttctcacttgataaatttttttcccaagactttattttcaggtaaatatttaaatttggtttctgattttaattttaataaatttaattatcataaaaataaattaaaaaaattcaatttcatggtattttcaaagttagacaatttcaaatttgtgcttgatgccagtggagaaaaaaatttttacaaatcaaacaattttgatttgcagtacaatgatcacaatttgcattctaacttgtttgttgaactatttgaaagtgggtttaatattagcacgaatttttcttatttgaataaagtttatcctttgcattttaatgttaatcttaaagataagtttattgttgccgaatctcctcttggtattaaattagattttaattattttgattctaaagtagtttatacccttaatgttaatgattttaaggtttacaataaaacctctgatcttttaataaatataaattttaatgggaactatttaggccttaatgaagatttgaaatttaaaatagacgagtttaatataataaaagtttctaaaacacctgcctataatttcaactttggttttaagggcttatatgaatatgataaattgtacatttctgatgttaaacttataaacaaactttcaaatttgcaaggatatggacaatttaatttaaaagataattttaatggaagtttgaatctattttctagcttaaattcagagagatattttttaggggttaattccgatgaatatggaagttattttttgcttaaatttcaagacttagatttttacaattttaattctttctcccttttagagggaaaggttaatggtaattttttgctaaattttaaaaagaatgattttaaaaattattctttgagtggatatcttgaggcakataaattaacttttttgggcgttcccgttcagttttctatgaatttaggattattggataataagcttaacatatatgacataaaagccaagcgcaataaaaaagagtttcttaccggaagcttaagatatgacctaagcagttctataggggtatctaatatagtttttaatagcgacttgttttcttacaggtttaatgcaaattttagaaatttccaaagtggagttgaagagcaatttggagttttgaaaaccaaaacagagggcgaatttttctttagagacattaagtataaaaatgaatctttatccaatcttacgattgaatttagcaatgattttgaaaaatttaatatggcttcaattgattatgaccttgttaatgttttatatcattatggcagtggggaatatagctttattttaaaagattatttgccccttagttttaattcgtcaggcaaaataattaaaaataaaattcttggaaatgtgagagatattaaatttgattcaaaaataatcaccaaagattttttggattcacattctttatttaatgttgacaatcattttattctttacgatcttgttttaaatggtgaattcgatattgatggggatttgtataatcctaatattaatggaagtttaaatattcaaaaaggatcaattagcactgagtatttaagagcttctagaaaatttggtggtgatagagctttagaaatatttgatatgccagttgcaattcaggataataaaatcatttttagtaatgagtttaacctagatcgatattccaagatttttgtttctactagtttaaatttaaattttttaagtgatactattattgattattacaaaatagatattaatgtgactggtagaacgggagttcctattaaatttgaaaaaattgccttaagctttacaggctatgctttaggcgatttttcaattgaaggaaatgctgatgaaattatgtttaaaggcattttaaatatttcaaatgcttgggtttattctcttgaaagttctgttgttgatttattaataaatcctttcaaacgagcaaaaagattgcaaactgatattaatcttctagattttgatattttaactgatcttgagataaattttgacagcggtgttacttttcattggccagatagtaatatttcttttttacaagctactatttcaagaggggataaacttgtaataaaatctgacacaaaaacagatgattttattattaagggagatttgaatattgcaagtggttttgttaattataataataaaaaatttatttttaaaagcggctcttatatatcctttaatgagagtagggctaaatttgatccatggataaaagcggaggctacaaatactattaaggatagaaatgataaactgcttgttacaataagcattgatagtcctttaagtttatggaaaattgagtttatgtcttatccttctagaaatgagcaggaaattaaatatttgctttcaggctcaacaataggagggtatgagggaggattgcgatcggcagggactaatgctgctgaaatggcaattggaatagtaagtgacattgctcttgattttttaattcaacccattgaagattatatgcgttctgtattaaacttagacttgttgagtataaagacagatatattgaaaaattctattaatagtaattttttcaaaatcgggaatcctacttttgttgatgttcttgacaatacaagtgttaaggtaggcaaatatcttgttgagggtgtttttattagtgggggctttggttttttgaaagaacaaatgtctcctttttcaaaagatttaaattttgttgtcaatttgggtattgagtttgattctccattttttttggttaattatgagtttgattacaattttatgaaaaaaggtttagatggaataggaaataatataggcatttcttggaaatttaaatattaaattgttaagaggttaagatgggttcaattagaggtttgttttttgtaagttttttaatattttttgttgtttttagttttggtcaagttgaaaattacaaggggaaaataataaagggtattaattttgaaggacttaagaataagaaggagagagattttattaatattttaaaaccttacattggcgtgtcatattctaatgaaatttttgataaattgcaaattgatctttattctcttgattatttttctgggcttattaagcctatatttaaaatagatggtgaggatctttttattacatttattgtaaaagaaaaatctttagttaattctgttgttttttctgatagcagtagagttttttggaatagcgaacttgttgagaaggtgaatattaaaaccaatgagcctttaaatcttgcaagtgttaataaaggtattggcaagcttgaagagatgtataaagacatgggatatcttgaggtttctgcaaattttgaaatcaaagaagaaggaaatttagttgatattatttttaatatagtagctggacccaaatatgttgttaaggggattgactttgaaggaaatttaagctttaaaagcagtaccttgaggaaatctttagcatcaagagtagtgtctcttttctcagatggtaaatatttaaaaagtaatgttgataaagacaagcgtcaattagagtctttttataaaaataatggatatattgatgttaagattatcaatagcactgttgatattaaagattcccttaaagattctaaaagactagaaaaggaagtttttttgaaatattttctttcagaaggcaatgtttttagatttggaaagcttgaaatttctggtaattcagtttttagtttggaagaattaaaaagttttattacctttagcgaaggtgatatttttaatgattctaaatttgagcaggattttgtcaaaattaaggaaagttattttagagaagggtatatttttacagaaattattccttcgcaaaagataagaggggaatttgttgatttgttaattaaaattttagaaaaggataaagctcatattgagtctattactgtttctaaaaataaaaatacagcttcgcatgtaatacttagagagattcctcttcaagagggagatgtttttagtttggacaagtttaagatgggtatggcaaatttacagcagcttggttatttttcaaatgtaattcctgatattgttccaggcaatacagaagggcttatgaaaataaatttaaacattgaggagcgagcaacaagtaattttggatttggtatgaattttggaggcaattcaaattcttcatttccattctcagtatttgggcagtgggagctttctaattttttaggcgaaggctattattttgcagcaagactaaatttatcttttttagagcaaagtcttagtttgacatttagagataattggttttttcaaaaaagatggaccgtaggtggatttatagatttttcacattccgttaatactgcttatcaggatattaatgggcctattttttctggcaagagggaagttcctgatccatttacaagttgggaagaatatcgagatgctaaaagcttttccgattttaatgctatgaattattctttgcttaaacttagttttggagcgtttaccgggtatactttttctaattatcttggcaaacaaacccttcttggcactttgcaaactgctttaaaatatgttttttatgataatgaggttaacagaccttcaaattattatttaagagacaattataaaacttttagatttgaaaattctcttagtttgagcgcggcttgggatacaagaaattctacctctttatctaataatggatttttacttaagcaacagtttgatttttttggtggatttttatttggtcagagccattttattaaatcttctacaacttttgagagatatttttctcttttgggatatgaggatgtgtttactccttattttgatattattttgaccttaaggagtgtctattcaaatatattacctcctcttggtaatggttttgaaattgaaattcaaccccatcaccacataattcttagtgaaaattttatgcaggctagaggttgggggattttgaaaaatatttacagttcttttgtaaatactgtgcagatatctattcctttgttaaaaaatattttagtttgggatgctttttttatagattttgcttcctattctttagaagggcaagaaaattctttgtttagaccttttagtagttttgcttttagctggggaactggaattagaagtcttttacctcaattgccgctgtcttttgtaatagcttatcctttttattttgacaatgataaagttaacagctattacaaatattattctggatttaaatttttcttaggaattgagatgagatattgattaatgctatggagaaatttgtgttttttttgattttaccattgttttttttattatcttttaatgttttttcgatagatgttattaagataggaattgttgattttgatagaattgtgattgaagttttaaatcctcaattgaaagctaatcttgatcaaataaaaaatcggtatcaagaacaaataaatacgttaaatttagagcttaagaatttaaaacatatgtatgataaatcgattgctgataatgatttagataatgcaagatcttttggaaatcaatataatttgaaagttgatgagctaaagagagtgtctagtttagcaaagaataatttagaacagcagagattggccaatattaatagtttaaataataatagtgaatctttaagtaaaatacttcgtggtattcaatatgttgcagaaattaatgggttttctttgattatgaaaaaaaataatccatatattctttaccacaatagcactgttgatataacaaacgatgttgttaagcatcttttagaaaaggacaataaaaacccttaaagttaattaaatttaaaacattaggctttttaataattaaatagcgtttaattgcgtaaaatattttttttatggtctttttattattttatattctttctttttaattgaattatatttattttataatatcaattgtaattcaatattatttaggaagcatatggaaaaaaatgttaccccaatgataaggcagtatttagatatcaagaaaaaatataaagatgctgttctttttttcagagtaggaagtttttatgaaatgttttttgatgatgcaattgaggtaagcaagcttcttaatttaacgttgacaaaaagagaaaatgttccaatgtgtggggttccttatcataccagtaaagaatatataaggaaattaattttatttgataaaaaggttgcaatttgtgaacaagcgtccaattctacttctggggggcctttagaaagagaggttgttgaggtaataaccccaggcgttattattgatgaagattttttaaatgatgatattaataactatttagttgctattagtgattataaagattattattcgttttcttatatagatttatctacttccagtcttggaataatgttttatgagaatggtttttttgaaaaacttaaaagggatcttgagaaatactctcctaaagagataatagtttctgaaaatttttattatgaatactcagagaagcttaatcttagtagatttttaattaacagagttcctacttggcatcttgataaggatattgcaataaaaacaataaaggagcattttaacatacttggattgagctctcttggatttgatgaggaaaagccctattacatttcaatttttcttattataaatcatataaaaaataatttaaaaaatttattaagtaatattgataaaatagatatcaataatgattcttcgtacatgtttcttgatgacgtaactcaagttaatcttgaacttgtaaaaaataataatgatttttcttctcaatattcattatattctgtgttaaatgattgcaaaactgcaatgggaaagagacttttaagagaatttattttaaatccaattttaaatatttctgagattaataccaggctagatcatgttgaatttttttgcaaaaatattagcttgactgtgactttaagagaaacttttattaatatatgggatattgagagaataatatctaggattcaaatgaaaagatatattaaaaaagattttttatttattgaaaaagctctttctgtattttttacggtaaaaaagttatttgacaagcataattttgattattggaattttgataaatttgaagaggatagtatttctaaagtttattttttgataaatagtgcaatttcaagtgcacctgatgaacttattaaaagaggttatgacttaaagcttgataacttaaaagatttaaagattaatgcaaataaatatattgatcaatatcttgaatcagagagattgcttagcaagattaataacctaaagattagaaaaactaataatagggggttattttttgaagttacaaagagtaattatgctcaagtgccaccacattttatggaaagccaagctttaaattcttcaaaaagatataaaacagaaaaacttatttctcttgaggtggatattaataatgctgaagataatgtggttgcttttgaacaggaaatttttgatgaaatagcatcaaatgttgttatgcataataaagttcttaaaaaggttgcagaattttttgcatatattgatttagttgttaactttggttatttggcaaaaaaaaatgaatataaaaggcctgtattgacatctggtaaagaaattcttcttgaaaagtctcggcatcctgttgttgagcactacactaaaaatactgaaatctttactgaaaattttgtaagaattaataaagaaaagtatttttgtttaattactggacctaatatggcaggtaaatcaacctatttgcgtcaggtggctttaattactttaatggcgcatataggctcttttgtgccagcttctaaagctttaataggtattacagataaaattttttgcaggattggagcaagtgataacattgccaaaggggaatccacttttttagttgaaatgaatgaaacagccaacattttaaggaatgcaacagaaaagagtttaataattatggatgaagttggaagaggtactagcacaaatgatgggcttgctattgcttattctattatagagtatattttagagtatattaaagctagaagtttgtttgccacacattttcatgaattgtcgtctattaatcatcaggcttttattaatctttcaatgaaaattgaaaagcagggcaacgatcttgttttcttaagagaagttgaagaaaagccatctcttaattcttatggtatttatgttgctcgcatagcaggacttcccttaagggtaatagatagagctaatgttattctagaaagtttggtgggccgagagggcaactcttgtttagagtttcttccccatgtttcttctgatggtaatgataaagagatcttgaaaaatgacactgatattcatattaaattaaatgagtatttagagttaaaaaattttatttctaacatagatattaataatattactccttttcaatcaattgagctgttaaatcaaattgttttaaaggttatttctcagtccagttagtatgagctatttaaatgttttaaagagtatatttttgcctttttgtgtcttttgtggaaaaaggtatgtatcttctaatgctctttgtgaccaatgtaagtcactttttaattttaacattaaatttgatgagaatttgatttatttttttgaatataaagagcattacaaatctttaattttgtcttataaaagggatgctcaaaagtcaattggtagatttttggcaagtggaattgctgaatgtttaaataatattgattttgatcaaatagtaactgttccttgtagttttaaaagaaaattattttatggttttgatcatatggaatacattggtattttgttaagccgttttggttttaattatataaatattttttcaagaaagtatggaaaaagccagaagttaatgaaagggaatcttagatttaaaaatcttgaaaataagattaaattaagatcaaaatataaaaattttcagtttaaaaagattgttttacttgatgatattgttaccacaggagcatctatgtgcatttgtgaagatcttattatgcaattgggagcttataaggtgataaagctttctttggccaaatcttataatttggtttaatgttgacattatttttgctaagtgttaaccttgacttaaggtttagtttatgtatttaataaggttctttaaaagaaccttattatttttaggaatacagttgattaagtattttgacaaaaataatgaagtttttaatttgataaaagatttaacagggcggttaaatgttgagatattagaaattaatatctttagaaataaaaataatggaaaaattcaaatagttctttatagtaaaaatttttccttagatattgattttttgactgatttgcataaaatgattttattaattttagaagcaaatcttaaatatggttttactttagagctttctactccaggaatagatagaaaaataaaaagtgacagagagtttaaaatttttgaaggtaaaaagattaagttgatgttggataatgaatttgaagagggttttatattagagtcaaagccaaaaagttttatttttaaaacagatagcaaagaagtaaatgttttttatagtgatgttaaaaaggctagattagtttaaggaggaagtttggatgataaagggcacggggcatatgattgtaaatattgcaaatgatcgtggcatgagtatagattctattagaaaaacaattaaagaatcagtattaatagcttataagaagtattttggaagcaatgagaatgcttttattaagtttgatgatgatacgggagatttgtctgtttatgcaaaaaagaaaattgtaaaagaggtaaaagattctttgcttgaaatattagaaaaagatatctcaaaggaaaatattgtagaaggtgattatgcttacattgaaattaatcccaaagtttttgataggctttctattcaggttgcaaaacaaagaaccaaaaatgacctgcaaggaattgaggataatgagattttatcagaatttaaaagcaagttgaataaggttgttattgggtacgttcaacaaaatagaaatggtgatctttatgttaatcttggtaatacggatggtataattcccaagaaatatcaatcgccaagagaagtttataaccttaatgataagattagagttttagtttataatgtcaaaaagggtaaaaatggtattgaagttattctttctaggacccatccaaagtttattgaagagcttttagcgcttgaaattccagaaattgaagaaggtattattaagattcataaaatagttcgcgatcctggttacagaatcaaagtcgctgtttattctgaaaaagaagagattgatcctgttggtccttgtataggacaaaaaggagtcagaattcaatctataattaaggaacttgaaggagaaaaaattgatattattccctatagtaaagatattaaagaatttataaaggattctttgactccttcaaagatagaacatgtttatattcttgacgaggatttacataaagctttagtggttgttagtgatgaccagctttctcttgctataggtaaaatgggtcaaaatgttagacttgctaatagacttcttgactgggctattgatgttaaaactagcagtcaatttgcagaaatgaaggctaattcggagtttaagcaagaaacactcgaaatgtttgataaagttatgcaagatgttgttgaggaggagcaatttgaagagattagtaaaataagtgatcttaaattgcttgatccttctgtgatttctaatttatcaaaagaggggtttgatgatattaacaattttttacaagcagatgagggagtgctttttaatcttggtgtaagttatgaaaaacaagaagaaattaacaaaatattaaaagaggggatgataataattgctaatgacaatgatgagtctatggaaaaggtagaagaagatgaagagcttctttgtcctgaatgcggtgttgttattaatgaaaatatgacctcctgtccgggttgtaaaatagggcttagttttgagtttgaggaggagtaggtttgtcgaaaaatattgatgatattaaaaatgaagatggcaaaaaagttaagattattaagttgaaaaagaaggtagtaaaaattgtaacatataatgatttaagcgttaaaaatgattcaaatagctttgttgatttgcataataacagcaataaggctgaatattcgcaaagtagagacaatagaactggcgggtattcacaaaatagggacaatagagctggtggatattcacaaaatagggacaatagagctggtggatattcccaaaacagagacaacagaactggtgggtattcacaaaacagagacaacagaactggtgggtattcacaaaacagagacaacagaactggtgggtattcacaaaatagggataatagaggtggatattcacaaggcagagacaacagaactggtggatattcacaaagcagggacaatagaactggtggatattcacaaaacagggacaatagaactggtggatattcacaaaacagagacaatagaactggtggatattcacaaaacagagataacagaactggtggatattcacaaaacagagacagcttatcctttcaatatcaaggttcagtaaagaaaacatatgttgccaaaaataattctcaaaataaatatactactacttctatgtcttttagaagacttataaaaactaaagttcccgctattgttagcagcacacctgcagcggattctgagaatagtaaagagttaaatcgtaagcttggcgagaaaaaaaaacagcaacaagagagtcaaaaaagctataagagaaaaaaagcagaaactgagagcaaaacaattgaacaaaaagtttttgaacaacttcagaaaaagaagagagaaaatttagccaaccctattccaaagtcaattgacattatgggtagcattactgtttctgatcttgcaagaaagatgaatttaaaatcttctgatttgattgctaaattaatggctttgggcgtaatggttactattaatgaaaagatagattctgatactgcaactattttagttgaagaatatggttcaaaagttaatgttgtctctatttatgatgaaacggttatagaagaagaagtggaagatcaaagcaaaagagttgaaaagcctcctgttattacaataatgggtcatgttgatcatggcaaaaccaaactactttctgtgcttcaaaatatagatataaatcaaacagagtccggtggtattactcagcatattggagcttatactattgtttataatgatcgagaaataacatttttagatactcctggtcatgaagcttttactatgatgagaagtcgtggggctcaagttacagatattgttgttcttgttgtgtcagcaattgatggtgttatgccccaaaccattgaggctatcaatcatgcaaaagaggcaaatgttccaattattgttgctataaataagattgatttaccagattcaaatcccgataagattaaacaccagctttcagaatacggtttagtatctgaggattgggggggagatactatttttgtgatgatttctgctcttaaaaatataggaatttctgaactacttgatatgattcttttacagtcagatatgatgttgttaaaggcaaatccatccaaaagagctattggaaaagtgcttgatgccaagattgatttggggcgcggaatagtttgttctgttattattgaggatggaacgctttatgtgggagattcttttgtgggtggagcgtgctatggtaaagttaaggcattaattagcgaaaagggtgtttctgttaagagcgttggacccgctaaagccattagtgttttaggattttcttcaatgcctcaagccggggatccttttcaagtaactaaaactgaaaaagaagcaaaattgatcagttctaaaagacaagatcttaaaaaatatgaatcttccaaaaatgtaaagaaagttactatgttgaatctttatgattcaattaaagaaggagcgcttaaagagcttaaaataattttaaaagcagatgttcaaggctcagtggaagctttaaagaattctcttgaaaaattaacaaacgatgaggttcgagtaagagttgtgcattcatcagcaggggtaataaccgaaacagatattagctttgcttcagcaagcgatgctattgttattggatttcatgtaaggcctactgcaaaagctcaggtactagcagatcaggaaaaagttgagattagaaagtacaatgttatttatgatgctataaatgatgttaggtcagttcttgaaggaatgcttgagccagatgttgagcagcagtttattggctttgctgaagtgagagctgtaataaatgttcctaaaataggggtaatagccggttgttatgtttctcgggggctaataaagcgagatgcgattactaatgtaatgagagatggtttacagattcattccggcaaaatttcatctttaaagcgatttaaagatgatgttaaagaagttgctgagcaatatgagtgtggtattatgattgataattatgctaatattaaagaaggagatataattgaagcatttgaggtaaaaaaggttaaaaaatcttttaaaacttagtattgttttatttatatgtgtttatgtataagaatattaaaaagtttaaacttgaaagttttattgctcaagaaatcggcaatttaatagtaagtggggggattaaagatcccagaattcattcatttttaaccgtggttaaagtagaattttcaaaagatttaataaatgctaaagtgtttatgggctctattaaggaaggtgcttctttggacaatgcagttaaagctttaaataatgctaagggatttattcaaagtcaaattattaagcgaattaaagttagaagcactcccaaattattatttgttaaggatgattctctttccaaatcattttatgttaataagttaattgaaggattaaatactacaagagagaattaaatttggaaaatggattccttttaattaataaagaacaaggtaaaacttcttttgaaactcttttccctataaaaaaatattttaatacaaatcgtgttgggcatgctggcacacttgataaatttgcaagtggaattttggtttgtcttgtgggaaaatacacaaagctttcaggttattttacttctttagataaagagtatgtagcagaattcagatttggattagaaacagatacccttgatccgaatggaagaatagttagtaaaacagattatattcctaatgtagaggatatagatttaaagcttaaagattttgtaggagagatttatcaaagtcctcctagattttcttctgttcatattgatggcagcagagcctataaacttgctttgaatggaaagttttttgaaattaaaaaacgaaaagtcactgtttataatattcaaagattaagttatgattttagttcttctttgcttagtttgaaaattagctgttcaaaaggtacttatattaggagtattgcaagagatttggcatattctctaaattcttgcgcgtatgttagtaatttaaaaaggactaaagtaggtatgtttagattaaaagattccacattgtgtgaaaatttgagtaaagcttccttaattagtctagaatctttaaaaagttttgaaaaggtttacattgattctaataagataaatcttgttaaaaatggtgtttattttgaaattgaaatcaatattaatgaatttaaaattttaaaatccagagaagagaaaatattagcagtaattcaaggagtgggtttgaataaatataaatatgtcattatattttaattataaatatattatgacattttaattttatatttgtttttttaaacaatttaataatttattattaaaaataacccgaaaaggataaattgcttttgttatttttaagaaaaaatattataatctatcgtagtagttattttaaattatggcaagaggtttgttagagctttgctataatggtataggagttgctttatgatagataaaaagcaaaagcaaaaaatagtttctgaatttggaaaaaatgaaagtgatactggttctgttggggttcagattgcacttattacaggtagaataaagtatttaactgaacatttaaagataaataaaaaagatcatagttcaaaaagaggcttgttaaagttagtagggcaaaggcgaagtttattgcggtattaccagaaaaaagatttagaagcttataggatgttgatatctaaacttggtcttagaaaataaaaagaggttgaattttgaggaaaatattaaagttgaaaataggcagagacgagttagtgtttgagaccggatttatggctaaacaggctaatggatcggttcttgcaacttatggtggatcttcggttcttgcaactgtttgttgctcgagtaacgtgagagaagatttagattttgttccgctttctgttgaatataatgagaaatattatgcagccggtaaaattccgggaggatttatcaaaagagaaggaaagccaaaggataaagaaatacttgtttccagactaatagacaggccgatgagacctctttttgataaaagatttggtcgagaaattcaagtaattcctacaactttagctacagatcagcttaatcctcctgatattgttggaatgaatgctgcttttacggcagtttttttgtcagatattccgtttaatggtccaattgcagctgttagaatggtttatttgaatggtaagtttatagtaaacccttcgtttgaagagattcatgattctgatcttgatattgttgttgccggaagtttaaatggaattactatggtagaaggtggtgctaatgaggttggtgaggatattttgctctcagcaatagatggtgctcatgaatatattaagcaaatttgtaatgctcaaaaagaatttttagatattgtaggcaagaaggaaaaacttcctttagcttttgaagaaaaaatatttgaatttaaagatgagcttagggattttgtttatgctgatcttaaagaagcttgttttgttaagggaaagcttaatagagataaagccataactttgctgcgaaataaatcttatgagtacttttcttctcttgagaaattgactgatagcaatgaatctctttttcataaggcttttgatgattttgagaaggagattgttagaagctctattcttaacgataatattagaacagatggcagaactcctaatgagataagagatattatctcagaagttgatattttaagtagaacgcatggatctgcgctttttacaaggggagagacgcaagctttagcggtaactactcttggtacaagcattgatgaacaaataatggatgatattgatggcgataaacgccttaattttatgctccactacaattttcccccattttcagttggtgagaccggtagactaatgactggcaggcgcgagattggccatggtcatttagctcaaagagctttagaatcaatggttcctggaaaaaatgattttccttataccattagggtagtttctgaggttttagagtctaacggatcttcttcaatggctactgtttgtgctgggagcatgtctttaatgtcagcaggggttcctgttaaagggcaggttgcggggatagccatggggcttattagcgaaggggataaatatgtagttttaagtgatattcttggagaagaagatcatctaggtgatatggactttaaagtggccggtacaaaaaatggaattactggatttcaaatggatattaagattgaaaatgttactaaagatttaatgagagatgctcttgagcaagcaagaataggtagaatacatatattatctattatgaatactgtaatttctaattcaagagttggtatatctaagtatgctcctaaaattgttcaacttcaaattgacattgacaagatatctcttgtgataggatctactggaaaaactgttaaggctataacagatgaatttgaagttaaggttcaaattgagcagaatggaaaaatcattcttttcggggatgatgattttaagatgcaaaaagctaaagaaagaatagagagtattgtaagagagccaaaggtaggcgaaatttatgaaggaactgtcaaaaagattaatagctttggggcttttattgaacttactcctgcaaaggaaggatttttaagtactcgtttgaaacccagagacagtaagtatggttctggaagatttgggaatagtaatagatattctagatttggtggcggtggagagaatataagaggtaatgcggggttagttcgacccccaaaattagaagaaggtcagcgaattaaggtcaaaataattgatatagacaagtttggaaaaattgatcttgaaattgttagagataaagattattaaaataatatgaaatttgttttgaataatttatttaaaggttgtcttatatgttttttcttgtttttttcctgccttactacagatagatctattcaagattctcatattagtgatattgtagagaagaaaaaagaagcagtcattattgatgataataatgttgttcttgggagtaatgagggtaaatttaaaagagactatttgataggattaaaagataatgaatctttttttcttagtgatgcttttttaaaagaaaataatttttattttaaaaaagccagggaaagttatgctaaaaaaaatattggcttgacaaattattatttgaataaaatagtaactaatgagaatcagcacagcagagaattgctagctaaagcgaatttgttttttggatatgtaaattatgagaatggtttttatgatctttccgaatataattttgatctatttttaaaagactataaatattctcatgctagtttaagattagctgaattaaaatatcttgttaaagaaaaatctgatgcaatttctgcatttaaagagattaatgaattttctatctcaggttatgatagagagatttatggctttttaagtaataaacttggagtaagtcatttaaacttagagtctttaggatttcttgacaacagcgtttttgatacatttgtctttaatgacaatatatttgtaactaatatattgggagggcttttaagatataatattaaaaaaaatgattgtagagtctatcttaaggataaaaaaagcatttttttaaatggcattaggggttttgcggattataatggaacaatttatattggtggtaaaaatgttgtttattatatagatgatgttgatggggatttaaagcaaataaatgttcccggtaatgctgattttagcaatgtacaagttttgcttgctgttaaaaatggaatatttgttggcactctaaattctggattatggttttatgatttaaaaaattggaaaaatataccgcttggatctaataaaatttcttcactctgctttgatagtttaaaaaatttattattagttggaacagttgacaaggctatttatagtgttaatgtcgataatttgaaaaagattgaacatttggatttttttagcaaaaatgataatgaaaaaaatattaattttataaaagaatataaagatagttattttgttggaacatatggtgggggtctttttgaattaaatttaaataaaaatagttacaaaaagcacgttattgccaataatattgatgttaattattttatggatatggagattaaagataaaaagctattgtttgcaacctttgatcatgggttattgatttatgattctgaaaatgacaactgggattattttggacccaataatgggcttcttaatttgaatttaataaaagtttctagatttgaaaattatgtcatactgggcactattaataacggtttggtttttgtagatgaaaatattaaaaaacagttatgagtcttacataattgctgaattttttaaatattttttaattacgtttttatttttctttttcgtattttttataaatcaaattttattctttatgagaatacttcttcaaaattatgttcccttttttaaggcttttatttttattatatattctcttcctatggttattgcgctttctcccccttttgcttctttgatttcagtaattcttactattcataaattcaagcttcacaatgaaattttagcttttcgttcaattggcatatcaatttttgatttacttgtcccattttttaaattgggaatagttattgcttttgtatcttttatatccaatgatattttacttccacttggatctattggcagattaaaaatttttaatgaaataaaagaagaagttccccatttggtattaaagccttattcaagcaaacaatatggagatttgatttttgtttctggtgagaaatcggaaaatggttataaaaatgtaactttttttgataacactgggcttaagggttttgatagaatatttatggcaaaaaatcttgatattagaaaagaaaattttcaagtgtattttattttaaatgatgttctatctattgccttaacagacagtgagagtggattttatgattatttttatgcagataagatgaaatattcaatcgatcaggttacatttagtgatagttttttattaaattatgtaactccttcacaaatgagcatgagagatgttataaaattaattaaaaagcaaaataatttaattgcagattcaaatataaaaaataatctagaaggagactttttaagtttaaatttttcaaatctttatttaaattatttatacaatcaaaactattatgtggatgaatcttatgtttttgaaaatttaaactatatgtataatttaaatttaaatttcaaaccttatcaagatagaagcatgaagcaaaatttggctctgtttaatcttgaattttatcaaaaaattagtttaccactttcagttttattttttatttttttagctttttcaatgggaatgtattctaatagaaaatattccattattcttgaacttgtaatttcaattattgtttgtgttttttattgggtaatgtttattggtggaaaagtttatactgtgcagtatgcaccaagtcctattattgttactattttgcctaatttaattttaattattgcaggagcaattctctttttgagattgttaaaaaaatgaaaatagataagctttttataaaaagcatcattcttacttttttgtccatgaacctgcttttcatgattttaattatgcttggtgatttgtttgttaatcttcttaactatcttgaaaagaatattggccttaaggatattctttatatttattatttatatttgccaaaggcattctcagatggggtggctttatcttttctttttgctatttcgaatcttattggcaatctttctatgagaaatgaaataataggtctttttagttgtggagttccacttaccaggatattaaaaccaattattttaattagtatatttatttcagttgttcttttcttttttgataattatttggtaatagatactatagcaagaagagatgttcttattaagaatagcattggcgacagtagatctggggataaaactataataataagggattttgctagagaaatttataatatcaaatcttatgatattgatgagaatacttttgctaacttgatgattataattaaagacaataaagatgagtttcaaacaaggtacgatataaataaagccgaatggaaagataataaatggaggctttatggtattagagagtttgttaaggttggtaaaaaaattaaggagaacgcctacgatgttcttgatgggacaggaattattaagctggcgcccgattacataagaactgtgatgctctcatcaaaggcgttaaattttactaaacttattaattggataagttttctcaaagctgaacgtttaaattattctgatgcattttttgatttattaaataggatattcttttcatttagattgattcttcttagctttactgttgggtttattgctcttgctcttaaaaaaaatatttttatactcagcctattaaatagcattgcttttgctgttgtttatgttatttctattgtaatttttaattttttagcggatctaggctatttgcatatatatatagcaagttcttttacaactatattttttttgattatcaatttttttgtttataggattgttaggaaataatatatataattatttgggatatttatatgtttagtgtaatcaagaatgataagcattttaatgcaagggttggatttttaaatcttcctcatggtagagtagatattccttgttttatgccagttggtactttgggggcaatgaaagggttaaaacatgctgttcttgagaagttagaatgtaatttgatgcttgcaaatacttatcatttatatttaaggctgggaattaaaactgttgaaaaatatgttggtcttcataattttacaatttggaataaaaattttttaaccgattcgggcggatttcgggtgttttctttttctgatctgagaaaaattgatctaaaaggtgtgcattttaaatctcatatagatggatcgtaccattattttacttccgagggaatatttgctatgcaagaaatttttggcagtgatattattatgccacttgacatttgcagttcttatgggattgattataatgaagccaatttatatacaaatattacaaccaattgggctagcagcacgttcaaatcttctaaaaacagaaaagagggatacaacgggcttttatttttaataactcaaggaaatttttttaaagatttaaggaaaagaagtatcaatgatatattggaattagacagcccaggtattgccattggaggcatttctgttggagaaccaagggagaaatatttagaaatccttgaatatagttttttgttgataccaaaagaaaaaccaaggtatgtaatgggtattggcactccccattacatacttaatgccatatattatggcattgatatttttgattgctttaatcccgcaagaattactaggcatgggtctcttttgacagataatgggattatgtgcattggtagaaaggagtataaggatgatacttctaaggtagagaaaaattgcatctgtactttatgtaaaaggtattcaagaggatatttaagacatttaataaaatcgaaagagctttttggaatagttttggcaagtgaacataatatccactatatgtttcgattgatttcaaagatcagagccgcaattctaaatgatgattttttaaattttagaacttcatatttaaaaaagtatgaagaggaaaatttcgatgaataaatatgttgtttctacaattttggtcatgatttccacttttttttcaagaataatgggctttgtaaagataaagattttctcttattattttggtgcaaatcttgatgctgatatttttaactatgttttcaatattcctaataatttgcgcaaaattctttcagagggcgcgatgacctcggcttttttgcctgaatttacacatgaaaaaaacaaatcgcacgaaaaagctgtttcttttttcagaactgtcataacctttaacattatttctattgggttaattgttttagttatgattatttttgcaaagcctattatgtattttatatcttattataggggagaaaacttaatttttgcaagttctgtatttggttatttggtattatatattttactaataagcctatcatcaatcttcgtgtctgttctaaattcatataaaatttttttcattccttcgttttcgcccattatgctttcttttggaataatattgagcatattcttattttatggtcgttttggaatatatagtgctgttattggcgtaatttttggggggtttttacaatttttaattccgtttgcaaattgccttatgattggttttgcctggaagccaacattttatttcagagaaaaagtgtttttaaattttttaaccagatggcttcgtatgatttttggattttccatttcaattattactcagcagatttcatttgcattagcatctactcttgagataggaagtgtttctatccttagtaatgctgtagtttattatcagcttcctgtaggaattttttatatttctattgcaacagtgattttccccaaaatggcagagcatgctgttttggggaataatataaaattaaatgcccttttagtagatggaattaaaattttattgttaatttttattccagtgtcttttttaatgtttatttggtctgattatattttaaatttatttcttatgggaggcaagttttctatttatgatactcaaaaaacagcgagtgttttgaaatgttttcttttaggtctgcttttttattcaatgtttggttttttccaaaaatattatttttctattcgtgatgcaaaaacaccgttttatttgagtgttttattttctattcttgatattgcaatatctgtttttggtattaattattatggtttgaacgctttagcattagctcaatctatttcttttatgatttgtgtaattgttttttattttataatattgaaaagaggagttaaaattgatttaattgaaattttatttgttcttttaaagtcaattattacactttttcctttatatgcaatttatttcttttttgaaaagtttcagtgggatgtggggtttagttttaaaaatctttattttttaatggcagctggaattgttagtatttttgttttgtttatttgttattctgttttaggaataaataagctttttagatatattagaagggatgctttatgaaatacttttattttttattttttttacttatttttaatgtgtatgctcaaaatgttaattctccagctcttcctagtccgcctttgttgcccgaaattacagaaaataagcctgttgagagagaaaattcttctaagggagagaatttttctaatgttggtttagatggtaagtatgttaacgatacaattctttatgggcttgatagtcaagtgacaagcattataaaagctcttaaaaaatcaagcgatagtcaatataatttttctcttaaaaaaagacttgagaaaacttttaatgctgagcttaaaagggaaatacttgaattgtttatttctcttaagtattcggggggcattgatacagcaaattatattcttgaaaattatgagagtaaaagatattcaaacgctttatttggcttggcaatttcgtatcttaaggagtttgatgataaagaaaaattaaaaaaaactcttattgacattcttgaaaataaagagggcaatgtggtatctattgcagcttattatttaggagagcttaattctcttgagtattctaaaaacatgatggaagtttttgaaaaatattctggaaatgatggggctagaagagaaatacttattgctcttggaaaaatgtccgctgttgattatcaggatagaatttatgaaatttcgctagataattacgagggcccatcaattaaggctgctgcaatcgaagcgttgtcatatcttgcttcagataaagtaactgaaaatgctgatttgtatcttcagagtaataacaataatttaaatgttaaattagctattattgcttctttgtccaaagatccttctttaaagtctaaagagattttacaaggatttttaagagattctgatgataatattaggtttaaagctattaatgcaatcaaaggacatagggactcttctgcaaaggatattttgatttataagcttaaaagcgatccatctcttaaagttagggaggcttctgctaaggccttaattgatatggatcttgggaatattgagataaaaaacattatgtttgattttaagattgacaataattttaaaatttcaatgtttagttaccttttagataaggattctctaaaagcattgtcaattgctttagaaattgttaataaagaaaatattaatagaccctcaaatgttttaaggggcgttgcttcaatgttggctggtaaaaagggtaattttgataatttttattctaaaatcattgacagcaaaaatattgatttaaggcatttagcattaaaaggagctgtttataataaatcttcatcgctttctgataagcttaaaaaaattaaaagtgaaacgaactccgaatatattaaaatgcttttaaaagattattgattattaataaactattaagcatattagtataaaatttttaaaatttctttagctacttctgatttttccatttctggcagttcttttatgctttgtttatttattatataaactttgtttaattttgaaccaaaatatttaagttcatttgcaatgataaagtccaagtttttcttttttaatttttctttagctttttgaattaaatttttagaattctcagcgcaaaatccaataacaatttggtttttaagcttattgtgtcctatgtgttggattatgtcgggattttttactaattttatatataatctattgattttattttttttaattttactattgaaaatgtgtttgggtttaaaatcggcaacagctgcggctccaattattatttcaaatttattatatattttgagagcttccttgtacatttccattgcagtttttatttttataatgttgaccccttcaggatcattttcattggttggtcctgtaataattgtaacttgagctcctagtttgacagcctcttgtgctaagcaaaaccccatttttcccgttgatgtatttgagaaatagcgaattggatctattaattcttcagttctggatgctgttataagtatttttttattttttaggtagtctttttgattaaattcattcaatattatttttataattttgtcttcatttttaaggcgccctaaagcatttgatgagcaagctaaaaatcctttatcaggttcaatgaatttataattataagttttaagcttttttatattttcttttaaaatagggtttgaatacattatattattcattgctattgcaaaataagtaggagccgtgcttgcagatattattgtagttaatgcatcatcagcaattcctgatgcaattttagatattgtgttgtaggtagcaggaataacaagaattaggtgtgcccattttgcaatttttatatgctccacctcattgtggtctaaatcccataaattagtaattattttgttcttagaaatggtttctaaagttaatggagtaataaatttagttgcattttgtgtcattataactttaactttgtatcctaatttaactaaactggaaactatgtaaactgacttgtaagaggctatgcccccacatataccaattaatatatgtttatttttatccatataatatatattatataatatacattatatttgaatttataaattttgatgtccttttgttaaggttgttttaaatgagaaatgggattttgtacgctatattattgtatgtttttatgtttgtattgtggttttgttttgcctattttattgacacatcaactactatatttaatattcctttgtggttttttttgtcaggaattttattccccagtataatttttttttggtttgtttttttattttagtaattagtaaaacttgatacattattgatatttttttatttttagattttcttaaaaaaagaaatagaggtaggtttttgttattaaataaatattttcttgcaaatcgaaatattaattttattgttatggctttgttattttcttctagctatattagtgctagtagttttatttccggtccctctgctgtttataagtatggattatcttttatattattagctaccatacaaattcctacaactttaattgtttttattattgttggtcagagattaaatcgcgaatcaaaaaaaattaatgcaattaatattattgattatattaggcatagatatgaaagtgattttttggcgttaatgagtggatttgtattgatttttttttcaatgtttttgatttctgcccaattaataggtggtgccaaacttatagaagttttttggggtattgattacgtagttggtcttactttttttgccttcttggtttttatttatgtattttttggcggctttaaggcagtagcttatacggatttgattcaaggatttttaatgctagtttcatccgttattttgttttccaagatgctagatttgggagggggtattaataatttattcaaaacagcaacgtctagcttagataaaagccttttacttccttcaaatgctgacttaaagccacaatatataatttctttttggatattaataggaataggaatactagggcagcctcagattattaataattttatagcatttaaagatgagaatgctataaaattttctcttcccatttctacttttattattagctttttaattgttttgatgcatttaatagggttttttgctattattctttttccagatttaagtccaaatgataaagttgttttaaatgtggctttaaaagttttaaatcctttttcttgttttatgttttttataggtcttttatctgcaataatgtctacagtggattcaaatttgctattaataacatctgttttaataaagtcaatatttatttataaagaagatttaaaagaagatgtaaagattggcagaataataatgatttctaatattttttttattttaataatacttatattttctctctttcctcccaattttttattctttattaatatttttgcctttggagctttggaagtttcgtttttccctattattgtttttggactttatttaaattttgtaagcaaaatagcggcttttgcttctatgtttttagggttaatattttatttgtccattttattctttggtttaaatatttggttttttcaccccgtttttccatcattttttgtttctatatttacatttttagtagttaattttttttgtaaaaaaaatagtaaggtttgttaggggtattttttgcgtttggataaatatatttttttagaagtgcttgctaatgataatggcaagcgactagattcaattttaattaaaattttaaatttttctaaagcgagtataataaaacatattagaaaaggtgacattaggctaaatggtttaaaatcacatttttcatgcagagtttgcaaaggtgataaaatttatttgtacaaatctttagcccaaaatttgaacttaaccacggataaatgctttaaaagcaatattgattttcaatatattcgaaaaagaataatttatgaagacagtgacttacttgttttagataagcaaaaaggtattttagttcatggaggtaaaaattctcttgattttttagtgaattcttatcttttaagtcaaaatttaagatccctaagctttaagccttcggcagttcacaggcttgacagaaatacttctggtattattatttttgcaaaaaatataaatactgcaagaaagctaagtgaggcatttagtggtggatctataattaaaaaatattttgcaatacttttaggcgaggttaagtctcctgttgtttataaaaatcatttatttagaaataaaaggttgagaaaaacttttgttttagaagataaaaattttgttaatgcaattacaaaggttaatccaatattatcttgcaaaagagctactcttgtcgagattgttattgaaacaggctttacccatcaaataaggtctcagtgttcctttaacaatcatcctttaattaatgacaagaaatattgtaataaattcaagaaaagcgattactttttacatgcttttttggtaaaatttaatggaacattctttaaaaagaatgaattttgctctaagcctagtttagatttttaaagcaagtaaaagatatttttgatgtctatgaattttcagaatttttcaagtgatttttttttaaaaaaaatattaagcaaggttaaagactttgcaattagcattaagcataaatttgttagggttaaggtgtatgcattagtaggatctgctggaactggcaagagctttagatcgcatttggtagcagataaatattcaatacctttaataattgatgatggtgttttaattaaaaatatgaaaattattgccggaagttctgctaagtttgaagataatgtttttaaagcggtaaggcgatctgtatttgaagatgatgctcattgcagagaaatgcttgaagtgcttgcaaaagaagaatttaataaaatattaatattaggaacaagtcttaaaatgatagataaaataatttcaaaacttttgttgccaaatgtttttaagattatttacataacagatgtttcaaccaggcaggaaatagaaaaagcaagaatttcaaggcaaatgggggagcatgttgtaccagcagctgcttttgaaataacgtctattaggcccaatttgctattaaactcaattaaagttttttttaaaagcggatggttctttgctaggaagaaaaattatattcgatctgttgtaaggccccatttttatgaagaaggggttttatctatttctaagagagctgtaaggcaaattattgaacattgtgtttctgagtatgatagaaattatattgtttatgatcttaaaatcaaaaaagatggaaacaattacctttttaaactgtttttaaatattcctcttggaaataacttgcttaataatacagaaatgcttagaacctatattattacgaacgtacttaagtatacaataattaatatattatctatcgatatagttatacataaattttatgacaaaaaagattatttagaagagagctatgaaggttgattttgacgatttgaataatattttttttgtaggaataaagggaagtggggcttgttctctggcttgttttttaaattcaaaagggtattgtgtagaaggggtagatgtttctgataaattttataccgatgaaattttaagtaataataaaatatcttattatgataatatttatgagttttcattaaaacagcttgataggtcttttgatttaatagtatattcttcagcctataataaggatggtttgcaagttttacttgaggcaaaagaattaaatatacctattttatcttatcctgaggctcttggagagctttctagaaagtactatagcattggaattgcaggttctcatggtaaaactaccactacggcgtttttaggtgttctttttaataaattaggattaaatcccaatgttattgtggggtcaagtgttaaagattttaaagataattctgcaatagcaggtattagcaatatttttattgttgaaacttgtgaatataagaaacattttttgaattttagccctaatatgcttattttaaccaatgttgactacgagcatgttgatttttttaaaaattatgaggctcttgaagaggcttttttacagtatattaataatttaaagaaaaatggaatattgataattaattccgatgataataatttgcttaaaattaaaaggcaaatcaacagaaaagatataagtatttttagctatgggtctggagatttatctgattttcaaataagtaatattgcagttaggagtgaatatttttgtttttcttttttaggcttgttaaatgttgagcttaagactgttttatttcataatgtattaaatttttcagcagcgcttttggctttaaatcttttcttagaaagtaatgggaaatcaatttttgattttgaagaagcaataaagagaattgcaaaaaattatagcggtataaaaagaagggttgaagttgttaaagaggaaaatggagtgatttacatggacgattatgctcatcatcctagggaaattaaaaatactctttttggtattaaaaatttttataagaataaacgtataattttggattttatgcctcatacctttacaagaacaaaagaattttttgccgattttgttgaagttctaagtgctgccgatatattaattttgcacaatatatatctttcaaatagggaaaattttaatccagatgaactttctgttaaattgtttttaaatattaaaaaaataaataagaatacttatttttttaaggatgttaaagactctattaattttataaaaagtttattaatatctggagacttgtttattacaatgggcgctggaaataattttattttacacgattttctgtaagggtgttatattgaaaagcatgacgggatttttttatttggaaaagataattggtaactatatgtttagtgttaatttgaaatcttataatggaaagtttttagaatttaaatttaggttaccagaaattttttctggctatgatcttgatataagaaatttgatttcaaaatatattagcagaggcaatgtttttttaaatgtaggatataaagaattggttcctagtgtgaattttacgattaatcccaattatattgaggctatttctaggcttagagattctttggcacataccaatcttaatattaaaaacgaactaagtttgggcgattttttatcattaaaaggagctttgataattgatgaggatagtgaacatcaagaagagatttatgggttgtttaaaggtgttctagaagaagctttattacattacaataatggaagaagttttgaaggagaaaataccaagtcagacatagtgtcaacccttgtgttaatagagcgggaccttaaaattgttaaagatgcttgcagtgatataaatgtcaaattatttgcaagtattaaagaaaatatttctaaattaatggatgaatttagagatttaaatattgcagaagaggcagctaaaatggcaattcgtctagacattaatgaagagatcatgcgcttagattctcatatagaaactttttataaaaatcttgaatatgagatatgtggtaaagctcttgaatttatttctcaagaaatgcacagagaaataacaaccatgagtaataaggcggttgatcttgatattaagaatttgattttgaatatgaagttaaatttagaaaaaataaaagagcaaataaggaatgttgaatgaaaatagcactttctggtaagagtggttgtggcaatactactgtaagcgggatgattgccaaacattacggtcttgagtttattaattatacttttcatgatattgcaagagagcataatattcctttttcagagttttatgaaaaagagataataggcagaaatgattattattgggataaataccttgataatagattgtctgtgctttctagaaaaaataatacagtgcttgcatctcgtcttgctatttggatttctaagagtgctgatttaaaaatatatctttatgctaaaatggaagttagagctgagagaataatgactagagaggggggcatgtattctgacgttttaagcagtacttttattagagatgaaaatgacaaaaaaagatatttagctatttacaatatagatattgatgattatttttcagagaccgatttagtgattgatgttacaaatattaatccaaatgaagtttttgaattaattagagatgaaattgataaaagaaacttgaaaaaaaatagctaaacttatttaatatgtttggtttataaggagattaaatgactaaagtgcctttaaaaaaaatacaagattttgatggaaatttttatgaacttgttgttgcaactataatgcgcactgagcaaattatagacaatatttctttagcagaacacgctatttttgatgataaaatattagggcaagcttttaatgacgttttgactggtaaatttagatattcaattgaaggaagatagagtagtttttatttttggccctacagctgtgggcaaaagcaatattttatttcattttccaaaaaataaagcagaaattattaatgttgactctattcaagtttataaagagtttaatatagcttcttcaaagccaagtaaaaatttaatgaaacatataaagcatcatttagtagattttttagatcccgaaaaggattatactattggaattttttacgaacaagctttaaaaatagtaaaagaaataagacagaaaaaaaaaattcctatatttgtaggaggtactgctttttattttaagcatttaaaggatggatttccttcaacacccttggttacttctaaaataagaatttatgtaaacaatcttttagagcttaagggtaaatcttatcttttaaaagaattaaaaaatgtagatcccatcagatttaatatgttaaataagaatgatatttatcgcattaaaagatcgcttgaggtttactatcaaacaggaattcctattagccaatttcaaaaaaaacaaagtagcgaatttaaaaatattgtgattataggccttaagagatcttttgaagatttgaaaaccagaatatcaataagaattaatgaaatgcttaatagtggactactttccgagattaaaggtttatttagcaagggttacaatgaaaatactccggcttttaaaggaataggctataatgagtttttgttatggaaaagtagaccttgctatggtttaaatgatataataggtttaataaacaaaaattcgtttttatatgcaaaaaggcaaatgaccttttttgccaaaatttctgatgttttatggcttcatccagaggatgatttagataacattttgaatttaatttttaaggttgataaggagatttagggagtgccttgcggaagaaaaagaaaattaaaaaaaatttctacccataaaaggaagaaaaaaagaagaaaaaatagacataagaaaaaaaataagtaatttattacattgatcggacttttgtccggttatgtagtaaagctatttagaatgatcaattattaaattgttgactatattgatgtctttgctaaagatgtatcttttagttcccttgtaattgactaggatccaatttccttcaattccatagcgctctgttttttctagtgttttttcaatttttacgacttcgtcttttctgagtagaattgcgtaatcataatccaattcgctatttttcttagtgcttttactaagaaaagcataatcttttattattatgcccattttattgctaaagccaagaatgctgcttttgggcaaatctaatttttgaatgagaggaattttgttatttttattgcaagctaaaagaattaaggatattaaatataatgtttttgtattcataatttcccagattttttatatactactttagtgtgttactataataatatagtattttttagaatttttaaggattgttaatgaagaaatatcttttttttattttatttctcatctcttctaataatttaattgtttcttatccactttcttttggtggaggtttttcttatcaatttactaattatactgataaaacaggcgccactaaatttgctccaaattttaccagagcagatcatgggattaatttgaatttattttttgatgcaaattatgtactttttgaaatgtcttacaaagaggcttttgttgttactcacaatgggagatatttctcgcttgggctttatggaacatatccaatggttttcaaagagcaggttagaatgcttttcccattaattgggtttaaatatgcttttgatttaagctctaataacttcaatctcttttttttaagcatggggcttgctgctgatctttttattcccgatcttgatggtttatatattaggcctttgtttatgctttctatttctccattttctaattataaaaatttttctgggttaacaactgagattatgcttggatttaatatcggttggagatttttcaattaggaagttttattcctaaatgaaatgggacaggtctttcctgtccaaagatgtttgctgtgaagtttaatttgtaaggagcgttatttgattttacaacaagagtgcttgagccccccccgtctagattaatagcgttagtcatgccgtagcttaatgcaaaatcaatagcttcattaagagaggcccctttgctattattgacaccccttccttctattgtaacaagaaataaatgcttgttatttttatcagttcctattattgttcttgggtgccttgtttctttaaaattttttttatactttccgtttttgattaaaacaaaaaatccgctaaatccataatcgcagttttctatttcgtcttccttgggatttaatataattttgttgtgctttattacaatctctccgtagttatttatttgttttgaaatcatttttttattatatatgtatagtccttttgggaaaaacatgttttgtttaacttcgtatggacttgtgttaattgcaatgtcaacattgttagaaattaagaaatggcttgttgtttggcctttaaagaagtaattatttagctttttgtcgtaaataggttttgatatggtaaattttagatctttattttcaattttcaccagaacataattgctgtttatgaaataatccctaataattttgtatttggattttttggtgattgatttggacagcattagtactgatgaaatacttaaaatcaatactagcagtgttaatatttttttattcatttctttttattttataagaataaatgcttttgggatagtttgttagtattatgtttttaattttatttgctaattttttatttttaaattttataagactgaatatttgataaattattttgacatctatatttttttcgttatttaaaatttttttgatttcttcttcattaatattatcttcatttattcttaattttagcgaaatgatttcgttttttattttttgatttttgatctttttttggtttattttttttaaaaaatcattagcttctttatatttttttatttttagataatattttgtaattagcagataatgttgttctaagtcaaaatttttaattttatttattgtttctaattcttttgacaggttattggttaaatcataaagcatatgtagctttattaaattttctatattttctttattattactctgtaattcaaaaggaaaaattaataaaaataataaaacataaaaaaaggatagccagttcataatttattataaacttcattgctgttaactttgaataatatttgattattatattttatattataacaaggctttcaaagtttagtttttaaaaaaagtaatttaattttttgtaaaccttatttattaatttttttataaaatgtaacttttgtatgtattctttgttttctataaggctttttatgctttctatagattcttctattgccattatgaaattttgtttgggttttagtctaaaatttccagaataatctgtttccaacgataaaaaaagagcgttttttttggggggaaagcttataaattgcattgtgcattctaaaagatttttcattttttcaggttcgtcaatgtttacattctttgtttcatatttttttatacaatgccaatcttttcccatgtttttgactatttctatagtttctaaaaattttttgttgttaaaaaccgttatatttttatgcatcaattgtattttaatttttttgagatcttcattattttgattgtttagttcgtttttaaaaattatttcttttagcgtttctaggttaatttttattacataaatgttatttttgtattccgctttgaaaatttttttccctattttgatttcattgataatttttgtctgcccggtatttgttatttggttctctttgctagatatgtcgttatgtttaaactcttcattaaggataatgtcatcaatccattctttttttaagacaccaatagatcttgcatacatttttgtagtttctataatttctcctgcaacaaaatatttcacagaatcggtgctaataagtgatccaggatgaattattacgttttgagccttgatggttttatatttcttttttgaagttttaaagcaaatataatccctcattcctctcattattgattttaaatatccttcgttgtcaaaaacacctttttgtattattggtatatttaatttgctaataatgttttcaagctgcatttgcacatttgctatctcttcaagtccttgtagatctaaataattttcctttgtgaaagcttctttatttagagcttttttaaaatcttcaaagatattaacaaacccaattaaatctcccattggatttttatattttaagtgagcttgtctagcttccatttcttcattttggggtagtagaaaaattccacttgtggataaaaatgatagacctattgtggtttgatagatcgcttgtgggtaatttatcattgcttcgactaatgctcttgaatgtgctggtattaatgggaatagtatcatatatttcccaatttctgtaagttcgtttttattgtttatagcatccagagattttaatattttgcttgcagtttgaatcgaatgcgttgatggttttgagataaagtcaaagtgggtaaaatctctaattccaatatctgccattctcaacactacctcagataggtctgttctatatatttcttctttttgataatcttctcttaattgataatcttctcttttgtaaagtctgtagcaagttccttttgaaagtcttcctgctcgaccagctctttgagttgctgatgattttgaaattggaacttcctggagcgaataggtatgagtttttgtttggaatttatttgttttaacttttccactatctattactattttaatattttcaattgtgattgaagtttctgctatgtttgttgacactattatttttcttttatttttaggagtagtcataaatatttgctcttgagcttctttgggcattctgccgtataaaggaaatattattaaatttttttttgagtttaattcttgtaattcttttatagtttcttttatttctttctctccagataaaaatataagaatatctcccgcttttttttcttttattacgtttaagacaatttcttttatttttaatatcattccttttgatgtgtttaaaagaggaggattgtatattatttgtactgggtaagtgatagtttcaatactaacaaccggtgcattattaaaatattttgaaaatatttttgtgtttattgtagcagacgaaactatgattttaaaatcatcccttttccttgaaatgtctttgataagacccaatataaaatcaatgtttaaacttctttcgtgtgcttcgtctattattattacatcatattcataaagcagtgtatctttttttagctcttgcagaagcactccgtcagtcattaatttgattttggtttttgggcttgtaatttcttcaaatcttatcttatagccaacttcttctccaacatttacgccaatatgcttggcaatatattcagctattgatactgtagctattcttcttggttgagttactccaatttttcctaattttgcaaaacccgcttcatatattattcttggtagttgggtggtttttccgctacctgttggactttctacaattaaaacattgtggttttttagtactttaattaattcatctttgtatttataaattgggagtttgaaatcattcatatttataacaagctgaatacatatttctcatttatttcttcaagattaatgttatcaggtaaatcaatcttctttcttttaattttagcataaaatttgtcgttttttttgtaaatatatattttgttgccaattttgtttttagaaaatgtgattgttttaacgattatacccactttattggctctttcgttgagtaggctgatggccttgtctagtgttatgtcatatgcttttaaatctttttttagcgagcaagcaatgcttccgctttcagttttaatataatccccaaaaacaccagttgcagcaatgatttgttcattggtttggggatgtttgccaattggttttggcagtgagagcaattttaaagcaagctccaatgttatgttttcagggtcaatttttttagttgatgctttttttgcttttattatttttaattttttaggttttcctttttttgtatattcttgaggggcatgggtatcttctccaagttgaacaatgtttccgtaaattgtatttttaaagatcacattaagtcctgttaaaggatcaaccccaagtatattgggttttagctctttttcatttattattttttctatttcatcttttttgtacaaattttctaatggagtttttgcattaattgagtaattatgtcctttgaatatcaaataaggcccatatttaccaatgtttattgtgtaattaatgctatttttattttctattttttgactttcaataacggttctaaattcagaggaatcaattttaggctctagttgcattactgtatcttttagtccttttttgccattataaaatttacttagatattttattttatctagttttcctattgctattttgtctaatttttcttccatattagaggtgaaatttagttcaatgagtactggaaaatatttctcaagaagatttattacagcagcgccttttatagttggcattaatgtgttgttaagtttgaatgcatattctctttctaaaagtgttgatataattgtagaataggtcgagggacgacctattccttctttttccattttttgcacaagagacgcttctgtgtatctaaatggagcctttgtttcgtgctcacttgttttcattttaactatggaaaatgtatctccctttttaattaagtcaaaatttatgttaagatgttcatcttgttctttagtgtgtttaagaaatccatcaaaaattatttttgtaaaacttgatctgaaaattaagtttttatatttaaaagtcagttttatattttcttttattgcatctttcattccagaaataatggttctatcccatattattttgtaaatttctttagcggttttgctttctatttctatggtttcatttggaataaatatttcagaaggccttattgcctcatgtgcattttgagccattttttctttttcataaattctatctttttcctctatatactctttcccatatttattttttattatttttgttattttatcttttgcaattttagcaatattatgagagtctgttctcatataggtaatgtatccgtgttcgtaaagtttttgagcgtgttgcatgatttgctttgttccaattttaagacgcttatttatttcttgttgaagtgtagaggtggtaaatggctttggaggaggtatttttatttttttagtttctattgaaattaattcaattttttgtccattttttaattctttttcaagctctatcattaaatcttgggttattattgttgttttggcaatatttttaagttttccagtttcatttacaaagtctttaccctctgctatatttttgccgtcaatttcttctaattttgcttcaagcaacaagttttttttctcgtgtttacattgaagtaaaattgaataataatttgcctttttgaaatttattctagttttttctttctctattaataattttaatccaacagattgtactcgcccagcagaaagtccataagctacttttttccaaagtagtggagagattgtatacccgtatagtcggtccaatattcttctagcttccccggcattaacaaggttcatgtctatatttctagtattttttagtgattcagttattgcggtttctgtgatttcatgaaatatcatccgtttgtagtttttgatttttaatacttcttttaagtgaaatgctatagtttctccttctctgtcttggtcggttgcaagatatatttcatttattgtttttactaatttttttagttttgatacaattggttttttattgctgggaataatgtaaattggattaaatccattgttataatctatagaaatatttgcccattcgtattttttatattcttttgggatttcttttgcgttgtttggtagatctactacatgtccaatgcatgcttctactagaaatgattcatcgagaaacttctttattgttttggcttttgttggcgattcaactattatcaactttttattttgcataaattccctatgtttatatattgtattataatatataaatataatttaagaattaaaaaaagtgagagtattttgtgagcaattataaaattctgcatacttcagattggcacattggaaaaaaaattgaaaatttttcaattcttaaggagcagaaaaattttttatattttcttttagaatttattaaaaaagaaaatatagatcttttacttgttgccggggatgtttatgattccaaaaggcctgggtttgaagagcaaagattagtgaataattttttttatgaactttcttttacttcttgtaaatggtgtgtggttatttctggaaatcatgacaaaaaggattatttgagtataaataaaaaacttctctcacggtttaatttttttttaataactgaatatgattctgatgagcaaatagttttattaaaagataatggaaatcttaagtttattgttgtttgtcttccgcatataaatgaaaggcttattttaggtcaaaattttgacaatatttttggactggaagatcagtattccagcaaactatttcttgaaaatttagaaaatgcctacagagaaaaaatatcaaatttatctaattttttagaaaacaagtataaaggaattcctaagatattaatggcgcattctttttttggcagcagtaaaaagattgacaccttgggaggtagttatattatcccttttaatgtttttggaaatggtttttcttatgttgctcttgggcatattcataagttcatgaaactaagagataatattgtttattcaggatctcctatgcaatattcatttaatgagacctgtgataaatacataaacgttttacattttaatgacaataaattaatcttgcaagaagcatttccggtgccgattttcaataaattaatctttgctaaaggttctttaaatgaagttcttgattttttggctaattccaaaaaagaagagtcttttactatttatttgaaaattgaacttaatgaggcagttgatactagcgctgaggagtctatttatgatttagcaaggcttaattttatgaatttagtttctatttcctattctttaccctcaagtcaggatttgcaagacgattccaactttattggagaacttgaagtgcttgaaatggatgaaaaatatttttttgagaaaaagttgagatgggattttgagaacggtgttattagggatatcaaatttaaggaagaagagcttatttctctttttaacgaggttttagctaacggatatttgggtgaatatgaggataaataagctcatatttaaaaatattgcttcttataaaggcgaacatgagttgaatttcgatacacttcttttaagacaatcgggcatttttttaatttctggtaatactggatcaggcaaaagcaccattttagattgcataactttggcactatatgctcgtgtttacagacttggaaaaaaaattgtagatattatatcaaaaggcgagactagcgcttatgttaaattaacgtttactatttctgggaagatttatgaatcttttgttgagcttaatgtaaaaaatatagagactcctaagagcatgttgcttaattgtttttttgataataggattatagagggtcgaaccgatgttttagagcatattaaaagtctttgtcgattagactttaaccaattttgtcaaactgtaattttaccacaaggcaattttcaagaatttttaacgtcaactcccaaagagaaagctgcaataattgataatatttttaatttgaaaaaatatgataatttggaattttatttaaaaagtgattttgagcgcacaaagtttaatatagataaattgttgaattctgaatcttatgaaaaatcaattcttgattatgatgagagtgagtgtaaatcccttaaaggttatttggatttggttgatattgatcgattagaaattgatcttgaaaatattagaagagctatttctttatgtaatcaggcaatagcgtctaatgagagatatttgggcttggaaattgaaatgtcttctctaaacgatcaattatcttctcagattaaatatttaaattctttagagaaggatcattcccttcaaaagaaattaaaagaaaatttggatttggatcgaaaagtttatttatgttcagatttttggagtttgaaaaatttagttgctgtacaaggcgaattgtttaatgatattggattgcttgatttagaactttcaaaagtgatgaataatttagaagaaattaaagatttgtatagcaatgattttaattttaattatgttaaggagctttataataaaaattgcaatctttttaatttaaaacttgttgagaatgattatcaaagcttgcttttaaggaaaaatagtcttgaggatgaaaaaaaagaattattaagatctcagagcaaaaaaaatgatgagattaaaagcatttcttctgagaaatctaattttgattttgacaaatatgtttactatgaagcattaaaattgttccaaacttttaatgatgagttgatttcaaaatatagagataggctagaatttttattaaaatctactggcaaagaagattttaataaaaataaggaaaaaaatattattaagattgacttgtataaagagttgttaaaatatcttgatgataaaaatttttctattgagagtgataaagagaagctaaaatatattgaggctgaatataaaaattatcagcataaagataaattatcgctttgcagtttgaaagagctttacgctttaaattcaaagcttcatttgatacaaaatcaaattgatgagcttaaatatcagctatcttgtagacaagaagaaatctctaaacaagaggttaatgctttggagtttgaaaagaataatgctgaaattttaagattgattggaaaaaatttatttgacaaatacataaattattttgacagagaaaaaattttagcatttgaaaataaattagaaaagcttgaacaatttaaggctaagaaaaaagatttaaaaattgaaatttctttgaaaaataaaaattttgatcaaaatcttttaaagattaaggatttattgttaaaacttaatttaaatttaagttttaatgattattcttctttggaaagggaatttaatgttgttttggctaagcagaaaagtgtggaaaatgaatggaatatgcttgttttaaatcttaaaaatttagaagatttaaaaattaaaaccgaaacacaaattaaatttacaaaggaatctatattgactttaaaagcgagattaaatgaagagcaaaataattttattaatctaatttcaaatttaaaaaatgttttttttagttcattttcttttgaatcaacaactgacttagagcaaattaataagaatagtctgtcttttttgcaaaaattgagtttatcaattagttctaagcttgaatttttatccagagatattgaaaagtataaaatcaagcttttaaattttcaaactcttcaaaaaaagattaatcaacaaaaaattaatttagactcgctaaggggtgaattaaatcttgctaaagaaaggaaagataagctagatgtattaaggaaggtcgttattagatcttctggattgaaatattatgttcaaacttttttaattaatgatattttaagactggcaaatgaaaagtatttaaggtggatttttcctgattttgagctcaaaacgaacaaagagagcaaagagtttgattttttaattgaagacaaaaaagatgttaataaaataagaacggtaaaaactttgtctgggggtgagaaatttcttgtgtctttagctttgtccttagctttatctgataaaataagggatagtgagttaaaaatagaggctttttttctagatgaaggttttggcaatcttgatgaagatactttggctcaagttatgcctaagctttctaagtttcaaatgatgactgggcgacaaattggcataatttcccatgtttcttatttgaaggagatgattaaagcgcaaatagttataaacaagatttctaaaatttcttatattgctatagaaaatttatgatcatttatgtacaattaggccttgaggataaatatgaaacattatttagcgattgatattggcgggactagtaccaaatattcgctttcagattcaagcggtgttttttttgataaaaatgaaataagcacaggtgctacttctgacgaacaagtaaatattttagttaatattattaattcttacaaagaatcaagtgatattgcgggagttgcaatttgtattcctgggtttgttgatcttaagggaaatgttcttagggtaaatgctatttctggatttgttaattatcctttaaaagagcgattagaatctttaaccggagtaagtacagagattgaaaatgatgctaattgtgtagccttagcagaaaaatttaagggtaatgctattgactctaataattttattgctataactcttggcacaggaattggtgctggaatttttgcaaatggcaagcttttaagaggaaattcttttatgtccggagaggttggatttatgattactggaggtattagcaacaatattccctttaattgcaaatgggaatccattgcgtctgtttcggctttaagaaaaagagttgctatgcgattaggaaaacctttaaaagaggtttcaggagaatttgtttttgatctagctgagaatgggaatattcatgccaaaaatgaagttgatagattttttgagaatttgtcatttggtatttttaatttaacttttattttgaatcctgaaaaaattttgatcggaggaggaataagcgcaagacccgatttaatagatagaatatatgaaaaattagaaaatttatggtctttagaaatggcttttgataataataataatataaaaaatcttgtagcacttgagcctactaaatttaataatgaatctggtaaaattggagctttgtttcattattttacttgcaaaaatcaaaataatacctcattttagtggagtggcagaaattttaggtttgaatatttgaagctagtttttctataaggctttcaacactagatttttgaatattaaattctatttcaaccgtattttggtcttttattgtggtctttatgtggcttgatattgtgaggtttgtcatgtttgtcaagacggttggaattaacttttttgacaatatttttagtattggtggattatttgttttgattaaggatttaaaaatatattcttcttgatttaagctgtttatagacaaagttccactgctaaagggaattaaatttttgctgcttactatttggtttgggagcaataatgttggatcttgaatccaaaaaaacatttcatttttttctatttccccaatatattttgttgttagcatattattgtcttttgcggttatatctttttgggttattgcaatgctagttctagctttgtttggaataatgtatatatttgaatttttaagtttccattttggatttgtaaatatattgcctattgattctgtatttctatttttatgaattccccagaaaatatcttttgggaaattacccattattagtagagcaaaatcgttattttcttttttatagctaaagtataaattgcttataagcccaagaactgatttatatttagggcttaaagagttataaatagacctgtttttaattaaatttacatgggcgtataaatttgcgccaggtaaaagttccattaagtaatttagattttgttttggaggagtgtaaggcaggcttgcgcatcccactatgaggcatgaaatggtaattatttttgttaatgtttttaacatttttcaattcctattagtgtaaatatgtcatcggcaaggtttatttttttttctagcttacttttgtttaatatgatatttaaggctaatgtttcagttttaatgtatttttcaaatttatttagcatttctttcaaagtttcattattttctatgtataaatttattctatcgctaacatcaaaatttttttcttttcttaaattttgtatttgccttacaaattctcttgtcagcccttccaagtacaactctttagtgattagtgagtctattcctattgtaatggattcttcatttattacttttaagttctctttttcttctctttctaatattatatcatttaatgataaataatgctttgcattggctacttttatctcgtaggatgttccatttattatttttattatgtcttcattttttagcttgctaatttcagtagataccgctttcatatcttttccaagctttttcccaagttctttaaagtttgcttttgctttgtaagttataagctcctcttcgttagcttttattttcatttcttttgcatttatttcatctaatattatttcttgcatttccattagcatattttgttcattttgattttttgtgacgatatatatcgtactaataggcatgcgtatttttatattgtgcaatgatctgagtgatcttgccattgaagttatttttcttgcgagatttattttctcttcaattgttttgttaatgaaattttcatttgcttttggataatcgttaaggtgtattgattgtttgtcttcatcagtttttaaattttgataaatctcttctgttataaatggaataaaaggtgcaagtaaaatcattaaagttttgattgcataatataatgtttcgtaggcatcatttttgtctttatcgttttctgatttccaaaatcttcgccttgatcttcttatgtaccaattgtttaatttatctataaattcaagtaaagattctattgattttgttagattgtatttgtctatttctgtatttagtattttttttagactttcaagttcgcttatgatccatttgtcaaggttattgtttttagccaggctgagattttttggaggtttgaatttatcaattattgcataagttgtgaaaaatgaataagcgttccaaatgggtattattatatttttaagaacgtctcttactccattgtcgctatattttaaatcatcagctttaactacagggctcattattaaataaagccttaaagcatcagctccgaaggtgtttattacttgcattgggtctgtataatttttaaaggattttgacatttttcttccatcgcttgaaagcacaagtccatttacaataacgtttttgaatgctgtgttttcaaaaagagcagttcccaggattgtaagagtataaaaccatcctcttgtttgatctagaccttctgcaataaagtcagcaggaaatatatttttaaaattaatttcatttgtgaatggataatggttgcttgcgtaaggcattgctccagattcaaaccaacaatcgagaacctcgcttgttctgataaatttgccaccgtctttgcttggccaggttattttatctatttggtctttatgtaagtcttcgattttttggccagataggttttcaagctctttttttgatccaatgcaaattttttttcctgtttttgagcatatccaaattggaattggatttccccaaaatctgtttctgcttattgcccaatcttttgcattttctaaccattttccaaatcttcctttttttaaatgggctggcatccaattaattttttcatttacctctaaaagtttggtttttattttttctacatttacaaaccacgaacttattggtctgtaaataattgggcagtttgttctataacaaaatggatacctgtgtagataattttctcttttgaataaaaaattgcgtaattttaggttttctattatttttttatcagcatcttttacaaaaagtcctttaaaatcttttacctgatttgtaaatttacattcagcatctaaggggtctattatatcgacatttgtgtgttttttgagtattctgtagtcttcttctccaaaaggagcaatatgaacaattcctgttccatcgtcagttgtaacataatcagctgtgtgtaccttgaaagcccccttatctttttgttctaaaaagtagttaaaaataggttcatattctatgccttcaagcttgctgcctttgaatttttctataatagtatatgaattttcatcatcgtaatagctattaagcttttttgatccaagtattaaaatctcttcttttgttttgtcaaaaattttagaatattctatttcttgtcctactgcaattccaaggtttgagggcaatgtccagggggtggttgtccacactagtaagtattcgtttttatcttttattttaaattttattgttaatgatgggtcattgacttctttatattctccaagattcacttcgaaatttgaaagcggagttgcaagctttggggaatagggtagtacatagtaactttcgtagattaaacctttttcataaagatttttaaatacccaccacacggattccatgaagcttatatccatggttttgtaacccttttcaaaatctacccatcgtccaagtctcaagattatatttttccattcttctgtatatctaagtactatttttctgcattctttgttaaaattttcaatgccataattttctatttcgtattttccagaaattcccaattttttttctacttcgtattcaacaggtagtccgtgagtatcccatccaaaatttcttttaacatacttgccttgcattgtttgatatcttggaattatgtcttttattgtgtttggaacaaaatgtccaaaatgaggaagtcctgttgcaaaaggcggtccgtcataaaatgtaaattcttcacatccttctctctgctttattgatttttcaaagatcttattgtcattccaaaattttaatattttttcttctattttaggaaaatttgccttgttttctacttttttaaacatattataattcctctttattctattattattttttctttttctaaataaatcgttattttatttatgttttgattttcagctattttggtgataatattttcttctattttcccctttattgcagcaattacgcttcttgctcctgaattttttttatagtattttgtggttatgaatttgtcaacatctttttttatttctatctcgattcctttagagtgaaattttgttttaagggtgtttaagtagtttttgcaaatttcttctacattttcctttgtaaggatatttaggatgatttttttttgaattctgtctaaaaaggataatttaaatcttttttcaagatcttggtttatttcttctttaaagctttttgtttctaagcttttttgttgatttttgttgaatccaatatttttttctccaagaagcattctagatccaatgtttgtagtcattattataattgtgtttttaaatagtattttatcttctttgctgtcaataagttctccgttttcaagcattcgacttattaggtttaatacagagctgtgggcattttcaatattttcaaacaatattaaagtttcaaatgaatgtcttaatttatttgtcagaatgcctccatcagagtagcctacgtatcctggatttgtgccaattaattttgaaatagagttttcttctttatagtctgacatatctagttttaatactgaattttgatctttgataatttttttagatatttcatcagttaaagcagtttttccacatccacttgatcctattaacaatattgaagttaaaggcttagaatcgtcattaagtccaagtttgactttaataatttctttgataagttcgcttaccgcatgtttttgtccgatcacctttttatttatttcgctttctatttcttttaattctaaaatttcttctttagtgttatttgctgttttaatagataatatttcatttattgccttttgtatatcatctgatgttatgatgttgtcttttgtaagttcttcctttttaattgcgccggcaatgtctattatatctattgctttatctggaaatcttttatttattagatatttggatgaaagttttactatatttaaaagcgcgcttttttcatagatcactccatgatagtcttcaaaattttttgcaatattttcgattatttttagtgtatctttttcatcaggctcttttacggtaattgtttggaatcttctggcgaatgctttgtcttttgaaatatattttcgatattcattgtaagtagttgcgccaataatttgtatttcagctctagaaagtgatggttttagtatatttgatgcatcaagagctccttcagagtttccagctcctattagagtgtgtatttcgtcaataaatatgattgtgtttttgtttttttcaatatacttaattatattatttaaacgatcttcaaactcgcctctatattttgttcccgataccaagtttgaaaccttaagcattagaattgttttgtcttgtagtttgctacttatttttttttgcactatgcttgatgcaaggccttcaactattgctgtttttcccacaccaggttcgcctattagcattgcactatttttatttcttctcaagagtatatttgtaagagttttaatctctgcttctcttccaaccaaggggtctaattttttggcttttgcaagtgctgttaaatttttgacatactttccaatttcaaagtgctcattttcaagtcgtatttcttcatcaaattctttgtaggtttcaattaatcttattttatttttttccatgtattctaatatattttgatctttaaagttaaagctagatttacttagtttatgttttttaagaagttttttattttttaatatttgataaaaaatttcttttgcccctattaaaggtttggatttaaattcctttttagcttcttttatgagagcaaagatttctttattgattttgggaataattatttcgtttttttctattaaaattttctctaatttatctatttcagatataacttcttgtttaatgttttttagagttttgctatctataaattttatttcggattttttgggagtggtaattatagacattaataagtgccaaattgaaacctctttatttttattttttcttgcaatttcttttgagtctatttctaccaaatttattaaattttctgttatgttaatatttttttatctccatctttattgcatttattatatcaaatattttatgtttttccttatactctagttttacagatatgtaaaatttaattttcggctctgttccagagggtcttacaattattgcaatttcgttttcaagtataaattttattgcgtttatggggtatttatattctttaatttctgaaatttcatttttaaagttaatctttttaagagttttatagtctaatttttcaattattttaattcctgcaaattgtactttttgttcttttcttagttttagcattaacttttctctttgaatttctccattggccccctcaaagtttttttctatattaaattcttcataatatccaaattctttgtatatcttttcaagataatccttaattgtttgttgtttggcttttaagtcaagtgctaaagaacaaattccttttatggctgaaaatgcatccttatctctaacctttcttcctattagatatccatgactttcttcgcatgcaaaagcaaattttttatttggttcatttttttccatttcattaattaagcttcctatccatttaaatcctgtgtaagttctaaaaatttgagaaccatatttttttgcaattttttctagcattggtgttgttacaaacgatgatattacaaatgtatttttaggatttttttcttttgagagtatatagttcattaaaatgcatgatatttgatttccgtttaagaatatccattcgttttgatctttaaatgcaatccctattctgtcggcatctggatctgttgcaagggcaatgtcacaatcttttttttttgcaagctctattactttaagcattgatgtttgtttttctggattaggataatttattgttggaaattcagggtttggtagtatttgatttttttctaaaaaaagccgtattttgctatttgcaaagagtttttttattatggtcccaccggtgccatgtaatgctgtgtaggctatttttaagtttgtttctttgctattcttttcaaaatcaggcaattctttgtttattgctttcacatactcttcgtctatttcattgccaagttctttgatgatccctttttcaatgccttcttttatggtaattgtatttattatgttttttgtatttttaatttcattagttattagtgtgtcatgaggtggtattatttggattccacctttccaatatgctttatatccattatattcttttgaattatgacttgctgttatcataacgccagcatcacagtcaaattttcttattgtataagatagttgtggggaaggtcttaaacttttatatatatatgtttcaaaattatttgaggcaaaaatttgagcagcattgtaagcaaattcttttgaaaaatatcttgaatcatagcttattgcaactttagggtttttgtttattttaagtatgtaattgcatattccttggcttattttttttatattatatgtgttcatgtaacatgttccagctccaatgattccccttattccagcagtgccaaattctagatctttgtaaaatctatttaaaatttctgttgaattatttgttttttgaatttttattgcttcttctttaaaatgcatatcttcttcaagaagaatataatttttcaattttcttttagcttcgatttttagcatcaatatttccttttattttattaaacaaagattaattaaattatattgatttataatgaattatatacttgatatagaatttattatcatataatttataagaatgtgtattaaattttggtcgttaaattaatgatagatttttttttgaagtcagaatatcttcctgctggggatcagcctaaggcaataaaagagattgaaaattctattttgcttggaaataaatatcaaactttaaaaggtgttacaggcagtggaaagacttttacaattgcaaatataataaaagatctaaacaggcctgccttagttgtcagtcacaacaaaacattagcagcacagctttatagagagtttaaagatttttttccaaataatgctgttgagtattttgtttcttattatgattattatcagccagaatcttatgttccttcaaaagatttatttattgaaaaagaagccactattaatactgagatagaaattaagcgaataagaacggtaacgtctcttgctaaaagacgagatgtaattgttgttgcaaccgtatcttcaatttatgctcttggatctccagattttttcaaaaaatcagcacgagaattttttgtaggtcaaaagatttctattaaagaaatatcagatatttttgtagagctttattatgagagaactttaatgaatctagaaagagataaattttcgattaagggagatattgttgaaatttggcctagcagtgaacatggagagtttgcttatcgaatttgtttagattttgatgaaattgttgaaatatatagagttagttcattttctaaaaaaaatttaggagctacaaatagttttactctttttgctaaatcttattttgtaattccttatgaaaatgtattagaagcgatacccaaaatatctcatgatttaagtcttcaatgtcaatattttaaagacaatggcaaacttgtagaagccgagagactcaaacagagggtagagtatgatttggaaatgcttagagaaacagggttttgttcgggcattgaaaattattctaaatatttgagtggaagtacaatggaaagaccttattgtctttttgatttttttccgaaagatwacttattatttgtagatgaatctcatgttacattgcctcaatttaggggaatgtataatggagatcattctagaaaattaaatcttgttaactttgggtttagacttcctgcagcgcttgaaaacagacctcttaaatatgatgaatttgaagcattaattaatcaggttgtgtttgtatctgcaaccccgggtgttgaagagaatgagaaaagtagtgtggttgttgaccaaataattcgtccaacaggtcttgttgatcctgaaattattactaggcactctgatgggcaaatggaagatctttacagcgaaattcaaaaaagagtggctcttaaagagcgggttttaattactactttgacaaaaaaaatgtctgaggatttgactgaatatttggtaaatcttggcgtaagggcaaaatatttacattcagagcttgatacccttgagagagtggaagttatttcgttgcttagaaaatctgaaatcgatgttattgttgggattaacctgcttagagagggcttagatattccagaagtatctcttgttgcaatattagatgctgataaggtgggatttttaagatctactacttcattaatacaaacaattggtagggctgctagaaattctaatggacttgtaataatgtattacgacaaaattagtttagctatgcgggaggcaattgaggagactaatagaagacgtcaaattcagattgattataataaaaaaaataatattactcctaagacaattgttaaaaagattcaaaatattttagaaaaggaacttaataataaaaataaaaatgttggctatgattttgaaaaaattatttcgggtgagagattgtctaaaaaaaagcttattgataagcttaaatttgacttagaagaagctgttaatgatgaaagatttgaagacgcaattgttttaagagataaaataaaagagcttagtagcaaaattagtatagctcgtaataaaaaaagagaggtgtaatttttggaaaaaagtttgaaaaaaaaaattattgtcagaggagcaaaagaacataatttaaaaaatgttgatgtagatattccaaaagatggtttagttgtaatatctggcaagagtggctctggcaagtcttctctggcttttgatactatttttgcagaagggcaaagaaggtatatggaatctgtttcagcttatgcaaggcagtttttaggtgtaatgaaaaaacccaatgttgattatatagatggactttctccttctatagctattgagcagagaacaataagcaataatccccgctctactgttggaacaattactgagatttatgattactatagactaatatttgcaaaaattggtaaagcatactgtccaaatgatggtagattaatagaagagcaatctttagataaaatagttaatactattttaagttattctgaaggatccaaggttatactttttgcaccaattgtaagggggtctaaaggctctcataaaaaggttttagaaaaaatattaaatcaaggttttaatagagttaggataaattctgaagattatttaatagaagatgcacttaatttaaatttacataaaaataaaaaacataccattgaaattatagttgataggattaagcttggtaataatgttcgagttagacttgcggaatctattgagacttctcttgctgtttctaatggatatttaagagtggaaattgataatgatttggaaaaaatagacaaactatttacagagcacaacagttgtcctttgtgtggattttcacttcctcttatagaacccagacttttttcatttaatagtccatttggtgcttgcagtgagtgctctggtcttggcgttacacttgagtttgattttgagagcatttgtcctgatactagtctttcttttaatgatgatgcttttcttacgtttaagacaagttcatcttggtctgtggctatttttaaaggacttgctaaacattataattttgacttaaatactcccataaaagacattccagataaagttcttaaacagattttatacggctcaaatgaaaaaatagattttatttaccagtccaaagaaatggaagcaaaagagctagatggaggatttcattattctaaaacatttgaaggacttttgccccttttaaaaaggcgatatcttgcaacagaatcagagagtactaaaattttttacgaaaatttgatgtctaaaaaaatatgtaattcatgcaaaggtaaacgcctaagcgttggagctttaactgtgaaaattaatggaaaagacattcaagatcttaccaatttgtcagtatttgattcttatgtattttttgaaaacttgcagcttgatatggtggacgaaaaaatatctaaagaaattttaaaggaaattaaaagtaggcttaaatttttaattgatgttggcctttcttatttatatttaaatagaatatcaggtagtctatctggtggcgaggctcagcgtattaggcttgctactcaaataggatcagcactttcgggtgttatttatgttcttgatgagccaagtattggtcttcatcaaagagataatgaaaaattaatctctactcttgttaatcttaaaaatcttggtaatactgtaattgttgttgaacatgatgagcaaactttgcgtactgcggactatattattgatatgggtcctggtgctggaattcttggaggggaaatagttgcaaagggagccttgattgatattttaaatagcaaaaatagtttaactggtcaatatcttagcggcaagtttaaaatagatgttccaagctctagaagaaaggcagataagggagaaattttgcttttgggctctaataaaaataatcttaaaaatatagacttaagtatccctttgggagtttttaccgtaataacaggtgtttctggtagcggaaaaagtactttacttaacgaggtgttatatccagctcttgatagtagattaaagcttaatgaaaagtattgtgatggctttaaagatattgttgggtatgaaaaaatcgataaaattattcaaataaatcaaaaaccaatagggagaacttcaagatcaaacccagcaacttatgttggattttttacagaaattagggagctttttgccaagcttccagatgcaaagtcaaggggttttaaagccggcagattttcttttaatgttaaaggtggaaggtgtgagaaatgtcaaggagatgggtatcttaatattcaaatgcattttttaccagatgtttttgttccttgtgatttatgtaagggtaaaaaattcaatgaagaaactttagaagttagatacaaaggaaaaaatatacatgatgttttagagatgagtgtttttgaggcaagtaaattttttgagaatgtcccaaaaattagtcattatttaaaatttttaattgaagttggacttgaatatattaaattaggacaatctgcaacaactttatcaggaggagaagctcagcgcattaagttggcttttgagttaagtaaaaagagcacgggtaaaaccttttatattattgatgaaccaacaactgggctgcattttgatgacataaagaagttgttagaggttttgcagcggttagtttccaatggtaatacagttgtactaatagagcataatttggatgtaattaaacaggcagattatataatagatttgggtcctgatggtgggttggcagggggaaatatcgttgtttctggtattcctgaagaggttgcaaaatgcgagaattcctatacaggaatgtttttaaaaaatcttttatagtatttttaatttttttaacattttctaatgcaatttttgcccagactatagatgatgaaaattctaaaaaaagggataagctaactttaagtcaaaaatcttatttaagagaacttgagctttcaaccgatgaggatttaaaaaaatgggccttaaaagagggtttaaaagaaacagatgtttcaaaaatacgagaattgcttttaaaaaagtttggaatagatcctgagctttttatcaaaggaaagggacttgccggatctggtagatataaaataatcattgaaactgcagataatcttgaaaatttcacttatggacttactaaagatgaaagtattatttttgaaggaagagttaatatcttggttgaagatattaaagaaaataaaaagcacaatattaaaggcgacagaatagtccttaataagaactctaaaaaactttatgctattggaaatgttgaatatattcttgatatggataccaatgaaaagctttatttttatggcaatgaatttcttgtcgattttgattctcaaaattttttattaaaaaatggtattcttcaaaaaaaaatgcaaaaaaatcaaatagatcatattctttcgtttggaggaaaggttttaaaaaagatagacaatgatgttaccattttggaacaagcttttgcaacaactagtaaaattccagagccttactattcaatcaaggcttctaaaatatgggcattgccctcgggagattttgggtttttaaatgccatattttacatgggaagagttccagtattttatattcctttttttttcagaccgggagatagtttgttttttaatccatctttaggtctaaatccacgaaaaggtttttctgtttttaataccgtttatctttttggtaataaatcttcaagtgaagattcttcttttttggattttgatttcaattctgtttataattcgggtaaaaaaccttatataagaaatggatatttaacttatttttttgcagaaaatttagcacccagtgttaataaagattatgttaagcttatttttgacatttatgctaatctgggattttattctggaattgattttaatttgggcaatactttggggcattttaaaactttggaaggaaattttggattgggttttaccaggaatgtttatagttacgatggaggatattatccttttgataataggactttaaaacaatctctttttagtttttccaatcttaacaaaggagatgtatttgggtttgaagttccttttagatatttatttaaatttaaaacagaatttcttttaagtgatgcacttttctcggttgttttagagcactattctgacccgtatgttaatattgattttagagataggatagaaagtgctacatttttttctcttttaaatttagataaagattcggttaaagagcaaactagcattagcacttttgattggaatttatcttctttttataagcgaacatttaatgacggttcgattttagattataaattaaataatttaggtttaagttttaaattgtcgggctatgaaaatctttatgttaaatctcctttagagaaaccaaaagatgttaatgatcctacaagaaaatggttttatttggagagaatttatgctccatatattgatttgaattttcaaaaagatctttacaataaccaatggacatttccagctgatactaaagaaatgataatgcgcccagaaattaaaaatctagaagataaagataatgataaaaagagtgtgaaggagaaaaatactaaaaaaacaacagaattaaccaaagatttatatattcctccagaaccaattactttaaaaaatattgatcaatccgattctttttttattaggtttggcattaatccttatttaagaaataatgttttttttgataattatggcataacaagtccaaaggactttaattatgaaataaaaaattatttatttgatataaaaaataaaacggatataaaaattcatgctgatttttacaatcgtttaattacttttgaaaatttattatatcttaatactattgagtatagtcctttaaataaagattttaaagttgaagataaagataaaaaaagtgagcactctattattaaccaaataaatttaaacttgcttccttttattagatatcctttattttctagaagtactttaaagtttgaaaataaggctactttatattcatttaataaaaaatatgattctgatgtaaaatctttggttaataagaatagtagtatttttttatctgatccggaaactttttatcaaagtttaacagcctctttaatttatgattatgattattttactactgagctttcaggtgaattaaaaaatagttttgaagatattaaagcttcttctgagcttaaactttctttagattttccttatttgctacaagaagctgggattggaattaaatattataaaaagtttaaagaagatgctatgaaaaactctggaatttctgctgttcaaagtcctttggagcctcaaaaaccatcatcgccttataaaaatttagaaatgtctcctgctttgtattataaaattgagccgagatatttggattattttaaatttagttttttagtcgcctatgatcctttgataaatagagtttctgaactttcttttaagcttaatgtttttgattttcaatttttgtttgctatgaaagacgactttgaatataattatgatcctttaaaaggagatttttccaagattggtactacaaccaaacttgttccatattctttagattctagttacaaaaaggaattgtacgttttaactttttttgacaataagctttcttttaccttgggggtagatgttggttggaaaataaatttgcagaaatttacggataatgaacttcgatctgcattgactttgaagtttaaatatacagaatttttagaaatttacttttctactttatctattaatactaagacttttaaatattttaaagggtatatggaccaaattggtctagaacctgttaatttctttgttgatttatcaaaatctttcaatttctttaattctcaagacagaaaagattcactttttaaaattaaaaaattttcatcaggctttaaattcaatttttatgattggaaatttgttggagaatataatttagaaccagatttattaaggggatctgatgggatttattctcctatttggagaaataattttacaatttatatttcttggaacttttttgctcctataaaagcgtcatttgaaaacaacaaagatacaaactacgagtttattattaatagaaaaacaaaaaaataataatgattttcatttattagtaatattaatttttgtagttcttgttattaaaacatttattgttttttttgcttcaattcctacttttgttatgttgagcttaaaaatagacggatatttaatagttgagcttaagttattgctatttttgtttttagaatgaatttttagtggatatactttaaatttaaatgaagttttaggaccaataaaaaactctctgtatttatttttataccctgtttcattgtttattgtaagatcttctttttttaagacgatcttatcgttgttaagactagtgttttgccaatttatttttactacgtctaagctattgtttgtaatttgaatataaatatattcatttgtagctttaattacatctatattgatgtatttagagggagattctagaactttaaaatcagtttcataatcatggtttatttttattgtcgtacaacaataaaaataaaccattgaaatcagaaatattgtttttatgtattttttgacaatatttctacttagttttatgaaaaccaagatctgcaatattttcatttcctggaataaaagaaatttttccaccttgttcttcaaattttttccttagttcagttgtctttttgattaaattaatagtaatttgtgttaattttttgctattatagattccttttgaccaatagtcaattattaatttactgtccccaaatatgtttattatattttcttttaatgctattttgagagctgtatatagggcaagcagttccccaaaattattgctaattccttgaaaatttttgacataataatttccatattcattaatcaaggatttatctaagattttatccaatattgaaattcttttttcgtttacaactctaatttctatgccctttcctcttcccgttccagaatcaaaatatattccatttgggtgatggtgaattttattctcattattaaatagccaattttgagcttgttctattgttttgaagctttttattttattgttttttcctttaatagcggttttgcattcttcccaggatttgaaaataattttttcattgctgttaatcaaaatacaggcataatatttgttcatgggtagtattaacttcctgagcaccagagatttgtaatgttgcaagctctcccaaaaattttttctttcgatttttttaattctattgcatctactatttctttattgtaaccaatgaatttttcttttaatgttggtttaatgagcctttttggaagcacgcttggaagtattcctgcaatcgtataagacatgtaaaaattgtaagctgctgcatttatttctccaggagtaattattcccgaaatttcgtaatttcttgatacattaagtcctgctattttatatattctatcaaccattaaagagcaataggttttgttgtgaatttcttcaagattgaatgaatctgtccataaattagaggatattaatggaaccatatatccaaagttattgtcaatgtatctacttcttccaaaattaatagctttttgaattgttcttatgtctgttattggtgagaatatttttaatattcttgattgtacgtatgttgaaagcttttcgtatcctgaaccttgagtagatgctgtatcgaatttgatttgattgcttgtaattattgattttatatcaaagctatcaattccattgaatgcaatttttttagtggcttcatatttttcttcatcaaatattcccacatgttgccaaaaataaaaaaattctgtccaatctatttttggttttattagtattatgtcgccatttgataaaatagatcttaaatttttaggagttatttcaatgcctgtatttgggtctattatttttggtattatatcgtatttattgttattatcggaatcggcagttgacctttttcttcttctgggcggggattgttttgaataatacagttcattgtgaagatctgaaattttttgtttttcaattattgtttttattttgctgttttcaacttttaaaaagtgcataaattgttcaaaatattttttatcttttatttttaataattgatttgctattatgtgcggtgcaatatattcttttccatctattatttcttttgttattgagtttatattttcttgaggaaagaatgagttgatgtgacttaattgtatatatcctaaatttttatcatgaaatgtttgctcaattaagtttaaaatttctttttccagatgcatttgtagttctattagttctgttaaattttcattatctgaatttgtatgattaaaatttgtttttttttcaaaagcagtatcaattttaattgttaaatttccattgacgctactttgatctataaactttatccattctgtttcattatttagataatttttataagcatttagatagttttttatttcttcaagtttttgagggcttattttgatttttgctgctgttttttttattaaaaaagaatcattgttattgtttaaaatttcttggatactggatattggtattcgatattctacattagaaggattttttattaaagagctttctagtagtgttttttgtgttaatatgatttctgatgtgcttaaattttttgacttattatctgcaattaaggcacaagagaataataaagtgtgtgtagttaatattaataatattaatctattaatattcttcatgattagtattttagcataattttttgtttatgtttttgatttgaagttttttagaacttttattttttcaattttttatatttatattatatttttaatattattaaaaatagttgatgttttttaatataaactatagtattttaatatatgacaattttcataaagggggaaatcgatggaagaagaatatttaaatccaataaatatattttcggaaataggtcgtttgaaaaaagttttgcttcataggccaggagaagaattagaaaatttgacacccttgattatgaaaaattttttatttgatgatattccttatcttaaagttgcaagacaagagcatgaagtttttgtaaatattttaaaagataattcagttgaaattgagtatgttgaggatcttgttagtgaagttcttgcttcttctgtagcgctcaaaaataaatttatatctcaatttattctggaagcagaaataaaaacagatggtgtaattaatattttaaaagattatttttctaatttaaccgttgataatatggtttctaaaatgatttccggcgttgcaagagaagagcttaaagattgtgaattttcgcttgatgattgggttaatggttcaagtctttttgttattgatcctatgcccaatgttttatttaccagagatccttttgccagtattggcaatggaattacaataaataaaatgtataccaaggttagacgtagagagacaatatttgcagagtatatttttaaatatcattccgcttacaaagaaaatgttccaatttggtttaatagatgggaagaaacttctttggaaggtggggatgagtttgttttaaataaagatcttttggttattggaatctcagaaagaacagaagcggggtctgtagaaaaactagctgctagtctttttaaaaataaggctccatttagcacaattttggcttttaaaattccaaaaaacagagcctatatgcacttagacacagtttttacccaaattgattatagcgtttttacaagttttacaagtgatgatatgtatttctcaatttatgttttaacttacaattcaaattctaataaaattaatattaaaaaagaaaaagccaagcttaaagatgttttgagcttttatttaggcagaaaaattgacataataaaatgtgcgggtggagatttaatacatggtgcaagagaacaatggaatgatggtgctaatgttttggcgatagctccaggagaagtaattgcttattctagaaatcatgtaactaataagctgtttgaagaaaatggtattaaagttcacagaattccgtctagcgagctttcaaggggtcgtggtgggccaagatgcatgtctatgtctttagtaagagaggatatttaatatttaagcatgtttaagcatgagttaaatgagtttttaaaaacttgattgtaaaggttggtggttgatgtataatttacgaaataggagctttttaaatcttttagattttacaagcaaagatattaaatatttacttgatttatcgattaatttaaaaaagtcaaaatatgcaggaattgaagtgcaaaaacttaaaggtaaaaatatagttataattttcgagaaagattcaacaaggacccggtgtgcttttgagatcgcagcctatgatcaaggggcaaatattacttatttgggatctaagggtaatcaaatgggctcaaaagagtctatgatagataccgctagagttttgggacgcatgtatgatgctattggatttagaggcttttctcaacagactgttgaatgtttggcgaattattctaatgttcctgtttacaatggattgacagatatttctcacccaacccaaatactagccgatttaatgacaataaaagaacataaggggagtttgaaagggattaaaatagtgttttgtggcgatggtagggggaatgttgctaattctttattgaaaggctgtgctattatggggcttgattttagaatttttgctcccaaagagctttttccagaccccgatttgacgcttaaggctaggtctttagccctagagagtgggggtaaaattacaattacagattctaaagaagaggctgttaaatgtgctgatgttgtgtatacagacgtgtgggtatctatgggggagagtaattgggaagatagaataaatcttctaaaggcttatcaggttaataaagagataatgtgcatggcaaaagatgatgcaatatttatgcattgcttgcctgcttttcatgacttaaacactgtgattggtaaggatatttttgataaatacggacttgatggaattgaagttacagaagaaatttttgaaagtaaaaattcagttgtttttgatgtggctgaaaatagggtgcataccattaaagctattatggtatcaactttgggataacagtattttttatgtgaaattaaatttatgaaattatttaggagaaacgttatgatcaaaatgccaagtagttttacaataatattttctttaattgtatttgttaccattttaacgtatgtgattcctgccggtaagtttgataaagaatttaagcaaatgggtgatggatctaaaagggaaataattgttgctggaacttatcaatatgtagatcgaggctctaggggatttttacatcctattatgactattttaaccgcaatgtcaaaggggatggaacatgcagttgaagttattgtttttgttttaattgttgggggtgcttatgggattattatgaaaactggagcaatagatgtgggaatttattttttaatcaagaagttggggcacaaagataagttgcttattcctttgttaatgtttattttttcaattggtggaactgtaaccggaatgagtgaagagacccttcctttttattttgttatgattcccttgatagtagctttgggttatgatagtcttgttggagcggctattattgctttaggagctggagtgggaactatggcttctactgtaaatccatttgcgacaggaattgcatctgcaatagcttctattagcttgcaggatggattttattttagaattgttctttattttgtatcagtattggctgctataacctatgtttgtgtttatgcgtctaaaattaaaaaggatccctcaaaatcgcttgtgtattctcaaaaagatgaacattatcaatattttgttaaaaaagatggactttctaccggagataatgctcagaatgctcttgagtttacttttgctcataaattagttttacttttatttggatttatgatattgattttgatatttagcattgttaatcttggttggtggatgcaagaaatgacaatgttgtatcttggagttgctattatatcggcttttatttgtaaattaggtgaaactgaaatgtgggatgcgtttgtgaaaggttctgaaagtctgctaaccgctgctcttgttattggacttgctagaggtgttatgatagtatgtgatgatgggttgattacagatactatgttaaatgctgctactaattttttatacaatcttccaagacccctttttatcatattgaatgaaattattcaaatatttataggatttgttgttccatcttcatcaggacatgctagtctcactatgccaataatggctcctcttgccgattttttgtcaattccaagagcttcagttgttattgccatgcagactgcatctgggcttattaatttgataacacctaccagcggagttataatggctgtattggggatatccagattgagttatggtacgtggtttaagtttgttttaccattatttatgattgagttttttatctctattttagttattatagctaacatttatttaagtttttagggctttgggttatttcttttctattgtagaaaactagtttataaaaaatagaaatattcttaaaaaaagtagaaggcttgatttataaagaatacaaatatatcaaggcaagatacatttttataatagtataaaagttcttataaataaaagattagaaccttttttaagagaaatattattttcgacaagttcttttaaagtttaggcttttagaaatttaaagaatttattaccttgtttgataggattagaacagagggtaatattttatttaaactttagtttgtttgattgcaatctgtaatgccttttattgtattgctaaatagcagcgttttaaaatagaaattataaagaatttttacgtatattcaataaataaaaaaagttagatacaatttacttttacaagtgaccaagtatgttttaggtttgtattaatgcatggttttagattatgtttatctataaattttttaaaatattgaaaaattcttttatagagatactaaatatagtcatttttgagctctgtttagtaaacatatttttaataaaaaagattttttaactatcaagcttttcgttatttaaataaaattataaaaaagtcttcctttaacagaagactttgattttaagttattagcctttaaaatatatttttttatttactcgtctctaaaaaatcatataatctatcgccactagaaaagattttgctctttgaagaatctagaaaagattttacttcttcaagaagctgttttacatcttcctttattttcattgcttcaagtatcctaaaagaagaagtacttaattggtttaaagcatcctctgcctcattttttgcctgtattgctaaattactatgtgttcttcttgcccaccatggccgatttttacgtttgttatttaatctttcagtaatagcagcttttaaagtttctttggctttctcaaaaaagtattttgcagatgctctctcgctaagtccactatttaattgagtatgaagattttcaatatcgcctcttttttctaataactgattgaacaacttaattagagcctgtttttctatcttattcttaatttctctcttcttatattctttttctttagtggtctttcttttttttatatagctatttatccttcctgcaacatgcacctctgcttgtattaaatctgcaagttctaagatttctttataaacattattaaaactagattctaattgcgcagattcatttttaagtttattttcatcatcaactaatttagcaaattcaagactcccatcgctaattgccttctctgccttcttttcttcatcagtatttggaaccaactcttcttcttttatctctatttcttcttgaagataatatgggaaattactctctacattaataggtgctacagaagcagcctgcaccatttgtttttcttttttttctatatgtttttcaacaatttctttattatctgcttgaattttctctaaaaatcctaaaattttcacgttcttgtcttgcatttttttacgagttaattcattggggtcacttgtattacatgataataaacttattagcattatcatgtaaattgataaatttttttttttcatattttctctcctactagaatctttataaattcatagttgtttaatgcaaatatatttctatttctataaaatacaatttttccatatcgttaattttttgttttaattttttatatttttgactatgtaacttataaagtttttataagttactaataattcttaataaatcatttttatttttattgtgtaattagtagatgttataatgaagggtatgtgcaaatgtatatattctttaaaactatttatagaaacaaaaccatcttgttgcttaatttgattttctttaacatttttagctttaaaaagcctctttcatattgaattagacttttaagtctataaacatcctctttaataagagttttttagcttactatacccccttttaaaacgattcaccaagaataccctattttttcttcacccaatatgtttgattgattatttgattgagtcttatttaaattaatttaaataaaatgaaaaaaataataaaataagtatatggtgtttatagctttgccttttattaaatattttaaatctaagtctttgatataatttaaagttaatttatgttattttagctattatatttttattatcagttttaataaaaatagctttacatatttattactataataatatttttggtaattttaatttctatttattttaataatttagaatttttttaaagaaaaaatgtggattcaaaagttttagtagccattaatttttattaatagcatattatcttgtacattttcatttttagtactagccatatgctcaataattgtataggttctataaatgtatttgttttattaatacttattttatgcattatctattgttgtgacatgtaaatttaaaaataatataaaaagccaagctatagggtttgaaaagttgtaggggggatcgtgttgattggaattctttattaccattatttaaaaacgccaataaaaaaagattttagggggttgtttttaagcttgggattcttatattgtatttttgtattatagatcttgagtttgttggggttttgccttatttttttatttataagtttggagagttttattttagtttttttggtaaatggagataaattttaaaaataaattaaatataatatattaatttagtaaaattatgagtgctaataaagtttataaatatagaatatattctaacactaatcaaatttttttaaaaagtatttagatgtgtaagatttttgtatagcaaaatgttaagtgatagaagagattattatgaaaagaataaaaaaatcttaatattaagccaagtaagtataaaaataaattttcattcttaaaggaagtttatagttttactctttgtaatttctaaacttgacttaaactctttgcctttagcatactgagcaacttttatattaatatttttattattaagatcttctctaaatctatatcttcttctttagtaaatttgtattttgggtataggtttaaatcagagcattttgtttttttaaggcattctttaatttaaggcaatattttttttagaataattgagtttatagtaaatttcagttccagaatttactaccaaatttttatggtagttgtttgtgacttttagttcttttgctaatttataaagatatttttgcattggttttagcttaatgagagtttaaccattccttttaaggttttcattaaaacaatgtagtatgttgttcttatatatttttgatatttgatgtttatgtactttagtgttgagataagaactattaatttatactggaacttgttgtggtaatttgtgccttttttattaaaaaataatctacaagaaaaaattaactttataaaagataatataaatataattgtttaagcgatacgtgctaaaataagtcagctttacatgggtagcgagtatatattttcatagagaattccaatcttaagtatagagcattaagcgtccctataaaggactattccatattacaaaaataacaatttgatcacatatttgcatctttctattaatatagagatgtaaataaaattatattcttataattataagatcctatgcttaaaaagattgaataagggttttaaaagaaattaaatatcttggttgtttatagcaaccttatttaaggttaaagacgatatgataactactttttgtattttgtttattgagaattacttctattgtgatatttggtcttagcttgctaagaaagcatatatttagtaattataaacttaacttatttatcagtttgaaaacaaaaaaaggttttaagatatgcattcaagttttaaatttgcgatatttcctcgtagtaataaacttttacattaaattttaaagcaaaatttgttattcaaagtagtgataatattattaaggaataactagagacttaaaagactgcaaagaaaatccttataaaggaattgaattaaacatgggccaaattaaacaaaatatttagttcatttagtattcttagtaaagaagatattaattttaaaaaagggccagatccaagtataaagaatcgcaaatctttattaaaggaatataataatgaaaactttatatttctttattctggggctaatatctatcaatttaatttaagattttttacttatgattatgtaaaagaaggttataagcttttatggataggatataaagaagatttagaaaaaatcttaactaaagatgatcagtacccaaatgaaagaatattttatagaagaattgcaagcaatacaaatgaaagaaccatgattagcactttatctcctaaaaattattattgtgtttctataaaatagatatgaattgtgagaaaataccaatatctttttataaaaaattgtttattatatctattttcaatgcactgtatttgattttatgattagaagatttgttttaaaataccgacattgtaaaatcatttctttgtcaatgtccaatgcctcaacccaaagaagaaattttggctagttcattatgtctaactttggtaaaaaacacttctctgctaatagctaaaaatgatcctttgaatttctctaatttgctttatttagagcattttgaatttagtaaagaaaaataaaataattttattatagctagtcttttattcattaaccaaagaagactttattactttgcttagtgattttaaggtattaaaaaacaaaaaagagaaaatcatattttgtctttaataaaaggatatgaaaattattcgctaaatactaaaaattttagtataaataaggtaaggaaaaaataataaaattaaaaaataagattttaaactaaaaaattaggtagaaaaaagaattaaggtatcagttaagagtttaaaatagacaacattttggaaatttatttttagaattattaatttttaattttattggtaaaatataattatgccaaatgaatacaaagatataaattttgaaaattcaataaaagctgtaagtagaaaaattcaaaaggataaggatcttattgaaaatgaagcacaaacaagacaaaatcttattgatccatttttagatgcgatgggctatgatcatactgatatttcaattgttaaagttgaagagaaggcagatattcttaaagatggactaaaaagggttgattatgttatttatccaacaaaaaaggatgaagaacccactattttaatagaggccaaatatcataatagcagggaaaagcttgaaaatcatctaaagcaattaaaaccttattttgaaaatattcgttctcaagcaaagagagttgaatttggtatattaacagatggcatagaatatagattctatactgacctagataaagataatttgttagacaatgagccttttatggttgttaatttagaaaaattaacatctaaggattttgaatatcttaaaaagttttctagaaattctttgaatgttgaagaggctagatcttttgcattagaaaaaaaatatacagacaaattttcagcttatttaaaaaaggaaacaaaaaatccaagtgttgatttgcttgatttttttaaagctaaaattggttttaaaaaaacatattcagataaaatatttaatgatattattaaaaatatttttagtatgttttttgatgaaaaaaaaagcgatgtattagtaaacagcaagaaaagtgacatagaagatgacacagattctggtataaaagataataatattaaaaccgaaaatttaaaaaaatttgaaaaattaaattccgatatgaaagcaatatataaagaattagaagattttatttttgttttaaattttaatgaaattgagaaagttgaaacacagtgctatacaggatttaaagtacagggcggatattttgtagattttagctttagacctggggtaaataaaattaatattactattactgttgctctagatcaaataattttaaaagagggttttactagatatattaagaatattggcaaatggggcagaggagatgttcagattctatgtacatcggattctcaagttgaagaaatcaaatatcttattaagttaagttataacaatattatttcaaaaatgaaaaaaatacattaaataatgtataaatattctaaatgttttattgaactactaatggcaggattgatatcttgtaatctagattcttgaattatcttgtaataataaagaataaaataataataatgtaaaaaagtttaggatagtgcccaagaagatgcctttaataatgtatatgctaatcaagaaaagtaaaaggcccctatttaaacttttggagaactgaaatatgaggatttaattattcctttagagtctgtaggttatgtggtgttttctatttatagtagtccttaatttttatgtaacgcatttttaaggtgtaattaattgtatagttaaagtttgaatatatttttttcaacgttatatttattagttatgatttttattctgttttctaaattatcgagattcttttctaataaagatatttcaatctttttattattgcaatattttcttatgttatcattaaacatgtggcgtataaagcccctatattatagtagccaatatttgagtttatactaatgtggtctagtaaacaagaattattaagtgacaattagcttattgtggcaattcatgcttattgttttttcaataatttttccaaataagtatcctattaatttttattattgatcatataaaaatatatatctttataatttatatttataaatttgcttaattttcaaagaaattgtttgtttacatgattttattgtagtttgttgtgaaaaattgtaagtttttgcatgaacttattttataatacatttacaataaaatagtagtaagatttttttcttgtaaaggttgttttaatctatctgatagtgattgatagtagtcttgtagttttaaaaactaatcttttcaagggagcaattaatttcataataaattatagatttggggattgttatcaaaagatgatttgactatgacttttggtttttctaatataccaaggtattcttgctgcaataaaaaatattttgatccctttatctactaattaccgttggttcagttatggctttgtttaattctaatcgttttttctatagaatatacaaatagagtagaaaaattcaagggtaaagtttaacatattctatactaattaaaaattatat

SEQ ID NO: 204 - DNA, 29766 bp, Borrelia burgdorferi
aaaaatatttttatttatattttattgtaattattcttaaatgatatataatatcaattaagaataattattatttataatatatattcctacttagataaaaggagatatttttatgagaaaaagtttgtttttatatacattattaatgggaggattgatgtcttgcaatttagattccaaattatctagtaacaaagaacaaaaaaataacaataatgtaaaagaagtttcgaatagtgttcaagaagatggtcttaatgatttatatagtaatcaagaaaagcaaaaaagctttactaaaaattttggagaatggaaatatgaggatttaattaatcctatagagcctataataccttcagaatcaccaaagaataaggctaatataccaaatatttcaattgtgcatactcaaaaaaaagagataaaagaggaggatttaatcccttctactaatgaagaaaaggaagctgatgaagcaattaaatatttagaagaaaatattcttcaaaactctaaattttctgaattaattagagaagtacgtgtacttaaagatgaatatgctttaataaactctgatttttatgatgtaattgaaaagattcacaataaaaaaacatcattaatggaaaattataagaacaatagagataagataaataaattaacactgttgcaaaataatttaaagataaatattgaacttgagcagcttataaatatgattgatattgcagaaaatgaaataagatctgcggctttcttttttgacaccgctcagaaaaggttaaaagaaagtattattaaaagattagagagtaaaaataatagatcttattatgcattagaattgtctagacaggctttaagtgacgcaagaagtgctttaagcagtttagaatcttttgcttttaaaagagctgaaccaatggtaagaaagaaaaaaataaaagagcttattaaacatgcaaaaactgttttagaaagtctcaataaaaaataacaaagaatattccacctataatttctatgaaatttaggtggaaataaatttacaaagtaaattaaataacaaaaataataataaacttattttttttatatcatgctccctagttctagtatctactagaccgtttgataatagatttacctattactctaaaaataggggggtcataattaggcctggttataaaataatgaaacatatcttagaaattcaaaataatatagcactaataacaacaagactatccaaaactgatcgtttttctcatgctttcgttacttctaaaatatcagaattaagcattattccactaggatatgttttcccaatttatatacaagaagatagcgaaacacctgagagagttaaaaaagaaaactttaaaaataaatttagacattttcttgatgttaaatacaataaaaaatttactgcagaagaaatacttggctatatttacgcaattctttattcaaatatctatcgagatagattctacgaacacctacaaatagactttcctaaaattattttcgtagataattctgacatatttgtaacacttggcaaacttggaacagatctcattaattctcatttagtaaaagttgttccaacaataaatatcaacattggaaaatgtttttcatttttagatgaaaccctaaaacaaaactcaatcatagaaaaagttttttataaagaagaaacaaatgaactttactataaccaaacttctagatttattaatgtttccaaagaggtgtataactatactattgggagttggcaaactctaaaaagttacttaacttatagaaaaggcagagaaatgccctcaaaagaagttgaacatctcgaaaaagtcatcaaaacaattcattatacaattggcatacaaaaaaaatagatagcataatttcaaatttaaaagagtttaatgaaaactttacattaaaatctgcttagaacagcaaagaaattcaaacaatatctttaagaaaagattcaactccataaataaaatctaaaaattgtgctaacatttgtttatcaaaacttaattattaggaggtaatattaatatgaaaaaaattttcacattaatattaatttttagtttaacaatgcaaatctttgcacaagataaacttgaaaaaggtgttggagtggagatatcgcgactgtaatgaaatatgaaagcgaaaaagcaaccatactagcaccattacttttgaatatctttttgtctttagggataggatcttttgttcaaggagattatattggtggtggtgcactacttggctctcaagtgcttggaaggaatacttataatggctggacacatgatcgtaggaggtattggaggcgttacagaaagcacagcaacagtaataaccggaggagtattatcaggaataggagggctcacaattgtagcatcctacataactggaattattattccatttaaatttgctaatagatacaacgcagaccttaaaaaaaggctcggcattgcacttgcgggggttgaacccaattttgacattggaataaacggattccaactgtcgtttaaaaaatcctattgaagatcaatttacctagaaaaagattgttcaaatattattagggcttaaagaaactctcttgctaaagaacttctttaagcccttcaattgtaaatgattccataaggcagctcaaacgtaaattattttacattcatactacgccatttatattatagattaaatttaaattaatatcaagcgtctttatgtgaactgctatttctaaatcaaagattatagaaatagcttcttgtttcatcccatgatagctttttaggctctaaaagaacggtcatccactagagcatggtccacaagctttacttcgggcagttcctgccttagtttttatttctttataagaataagccttaaggtttagacttgcatttatatctctatcatgcaaagtgttacaactactacaagtccacttagcatcacttaatcttagagtcgtatttttaatgtgacaactactgcatagtttacttgatggaaaatctctatctactttatacaaagaggatccataccactctgatttgtatgataattgtcttacaaactcagaccatcctaaatcattaatactttttccaaacattcctttttgcatgcctttaattgataaattttctattactatgtttttataattggatacaaagtaataagataatttatgcaaaaagtcttttctttgatttgaaattttcttatgcagcttagcaactcttaatctagatttagccctattaatagaacctttttgcttttttgatagttttctttgatattttttaagtttattttcattttttaataaatatttaggatgattgattttctcacccccactacttactaaaaagtgtttcatactcatatcaataccaactatctcttctttatcacctttagtttcattgttatttttagtatctaagcactcaactgttattgaaatatgatatttatcatcagtatctttttctactactacatttttaacaagctcattatctttaatgcacctatgtagacacaactttataaaccctattttaggtagtttttataaccattttctattcttattgagtttttttgattattagttctataagtttgcctatttttcttacttttatatttaggaaatccttgcattttatttccttttttaatttctctaaaaaaattactatacgcaaaatttaagtcgatccacgcactacaaagagccaaactatcaacttcctttaaaaaaggaaattcttctttatatttacttggataggtaataagattttgtccattatttttataataatctttcttatcacttaacattttgttatacaaaaatcttacacatccaaatacttttgaaaaatattttttttgattggtgttgggatatattctgcacttataagctttattagcactcattattttttataattataatattatattttaacttgcgttataaattcatctccacctaaatatgaaaaaattcataaaaattaaatattgagagttaggcaaattataattttatctaaaaataacaaagaatactccacctacaatttctatgaaaaaagtatttacttttctgaaaaaattgtgcattatatataatataaatcccataaggagttcaacaatgattaataattcaaaaaagccaaattgtcacaacaagttacaacaaaaattaatagttcttctttcaacacttgcatacgtaaacagcaaatataataaatatacccaaaaaaacatactctattgctttaatgaaaacctaaaaagaaatggacaacctaccactacactaagaacaatgcaaaattatctttataaattagaaaaagtatttaaagtaacaactaactactacaaacacttagggataaatttcggaactgaaatttactataagctaaattattctaaaaaagagtgttatcttaaaatcaatcaacattttagagaaaaaaaagactataggtttaaagctagagttgataactatcttaacgacaaatttaataaaaatgggagtgtagatttagtggagtgtttaaataataaaaataataatataaaagaagaaagaaagattatacaaatagaaaagtatcaagtaataaaatacttcaataaatgcaacttttctttattaaaagaaattcttccaattttaaatttggatattaataaagatgaattgattaaaatactcaaaattataaaaagaattgaaatcaacctaacaaaaaataaaaatacatatttaaatgtgtcttattttaaagaaaagcaaaacaaattaaagaaaatattaagcaacactcaacaacaattagaaaaaaatggatataatcctgagcaattagaaataagtttccaaaaaatatatgaaaattacaaaactaaaccccattttatcattgaaaatcataaatataaagatttaagccatataaaacgcaaattagaaaaatcaattgaaagaaaaaaagaaaacttacaaaaagattgcgaaaatatgaggacaaacattttcaatatactcattgaacaactaaaaaaagaagtaaaaattgacgttttaaaaccaattttaaaaatctatttgaatagcaaaaataaattagaatataataaagtatttaataataattattattatgaattattagaaataataaaaaaggaaaaaaatcttcagttaaaagaagttgtataagaattaaatatgcaaaacatggcaaaatccatacaattagttaaaccaatagttagatgttcaaataaaaaagatctttttattaagattgaaaaagataatgataaaacaatatatcacacaaaaataatgatggatatttataaatttggacttaataagaaaaaaaataaatatcgtatatcattaagaggattatttaatcaatcaaaagttgaagaatttaatttatttacattaagagcagatgataaatttttaggcatttattacgggtataaaaaacgaataaagaaaatttttgtgaagtaccaagttggcggaattgaaaaatcttattctttgtcaaagacatattacatggaggttagatttaaaaagggaagtattttttgctactttaagagcttacccaggatactaaaaaaagaaaatgttaatacgacctacaataaagcattatttagtatgtttacgacattagaaaggcaagtatatgatttttatgataaaaaatacccacaaaaaggaccttttataaaatggatagaaaaaagttggctaaaaaaccacatattatagctattgcttcaattaagggaggagttggtaaaagcacttcttcgataatgttttcaacaattcttagcaaaactaataaagtgctacttgtggaccttgatccacaaaacgcagttacaagttattttataactcaagatcatccgagaatggaattaattaacatttataattcttattctttaataaagaaacataaaacttttaaggatgttgttattagtatatctaaaaatttggactttattccaagttatctagagcttgctaaatttagcaaagaaggaaatcaatttaaagaactcatgcttagaaatgcagtatataattatttagaagattatgattacgtgataattgatactcccccaagtttatcgtcagagcttgacaatgctcttgtgattgcagataaagttataataccggttccacttgaaaggtgggcagttgaaaatttgccattactaataaatcagataaaagaattagaaaataattttatggggaaagaggccaaaattattcatatttttgcatctaaggttgaaataggaagggttacttcaactgaaattatgtctttattaaaagaaaaatatttaaataagtttattggagaagttcacaaaagcgaagctttgaaaaagataatagattatgctatagggccaaaagaaaacgaaaattactacaaagaatatttaagaattttagaaaaaatttagcatgattttttttaaaaaaagtccaggcactggacttttttagagaggagtttaaaaaatggtaaaaaatagaaaagtaataataaatgataggattgtaagaaatgctacttatattaatactgaagaacgagacaaaaaagagtatgaacttttaaaaaatgaacttaaaaatagaatagaagatgatattagaaataaaataaatacaatgaaaattttactagaaattagaaatagaaaactttatattttagatggatataaaaagtttgaagattttatttttgactttaaaatagccagaactcaggcgtataagtatattaaaatagcaaaacttatttttgaaggaaagcttgaagaaattgatattatagaaaatgggattgataaaactttatttaatttgatgaaagataaaaaaattaactctaaagcaaatttaataacaccacttagggttaggctagaaacacaagaggcatgcgatttttacaaaatgaatccaaagtttgctaattatattcttgaagatttttatcaaaaaaacaaagaacagcttattaaaaaattagaagaatataaaaataaacaaaaatactcttagtatatttaagcaaacttttacttatatagaatttttattctaatagcagagtaaaagaaaaagaccattagcaaaagctaaaggtctttttcaaggtattgatagttacataataaattatgaactatcaatatcaatattatatactaaaaaagataaaatatcaagaaatttgaaaattttttcatatttttctactctgccattctgaatcccattaaatgttcttttgattttagcattctaactaatttctcagcatcaagcacatctccattaaagttatagtaaaaattatttacaactgtactgctttgagttttttgtaatttagtaatttcttctgcaataattttagcttcaagtttgcgtagattttcatctattggtgctggagttattcttactaattctggttgaccaaactcactagacattacacctgagtttggcatatatgtcggtttatttgaaacaaatcgtgcaccgccatgagcaagttttatctcttcaatagatccagctgattttacttttgcaattctttttagtatttcgtctaaaattttttgtgtttttcttaacctatcaggcttgcccaaattccaccaatcttcagcatttaccttatcaacttcggcctgtgcttttattcgttcgggctctagtttagaaagtttgtttttgcgttctacttctagttttttagcctcttcggtcttagtaagttgggtggtttctatatctttttttgttttatattctgtttgtacatcgtgtaatcttttttgaaattcttcaccagatatttgtcctttactttgagcttgtttgagaaattctatttctttagtgtattcatcatctaattcgctcaatttttcttttctcattttgatttcttcatcaaaacgatcttcaagctttttaagttcgacttcacttcgtttttcaagttcttccaaatcttcgtcccgttttttttcaattgctttaattctcgctttttcttgccccttcaaaattccccaaacaaaatcggtcaatccgtttataagctccgcaacagcttctccccaaggtccaaaaactgctccagcagcagtttttaatccagttttccaagattcgtacatttgtgttgtcattttttccagaccttcaccccaattcacatccttcccattaatcaaattatgaaattcttctccaatactttctcccgtatccttattcaaaaatttgcccgctatatctttcataaaggcattcttaaagacatttaggccgtctatcatgctgtcatataagctttttgtcgtatcttgagctttctcagcatattgttttatagtgtttctattggtttcatttagctttttaaattgcgatttgtgctcatccacgaattttttatacattgcttgaattttggatgccatctttttttcagcacttgctctttcttttgctggaagtagcattgtttcccactctaagtcggttatttctttttgcagagctttttgagcctcgacaaaagatcgatctaaagcggttttttcatattcattaacctgcttttcaagtgcgactacaacttgcctgttagactcgttcagagtttcgaaactttttccatatttttctacgaacgctttgttcttttcattgatttcatcattaagtttctgtaaagcgcttacttgatctgtatggggcagagttttgattatttccctttcacgactttctttttcttttagtaaattttggtactcattcacaaaatcataattggagttattgaactcatttactgatttttcaactccgactaaaattttcttgttctcgtcagttaactgatcaaatattttggagtattcatccttaaacttttggtttttttcatttatggttttttcaagattccttaaggcttgttctcgtgctttcccggtcttattatagatgtccctctgcctattaaatatttcgtcttgcagcttttgatagtcttctgccattttcttgttaatattggtttttgcatttggatcaaactttttatccctttcgggttcggaaccagaagtgtctttttccttttcggcttttttccaaaaagtaaccagatttttcaattttgtatacgctttggatatcatatctatcaacttttgaacccatttgataatgggctcaaacgcacccttaaaacgatctaaaaatccactagaaacatatgttgcaagttcttttagcttgccgattacgtatttgattccctcgtagagcttaacaaagggcgtggtaatggccttgaacaacattttcatgccttgcacccacttgccggcaagatatgctacaagctcacccaatttggtagttaagtatattgtagctgtagtcaccttggtcaaaggaaccatgattgctaccataagaaattgttttactttttcaaatccaatcatcattggctctagagcttttccaatgtctaagaaaagcttttcgctcattttggcagtttgttgttgagcttgagctaaagtttttgcttctttggcggtgttcccataaaatttaccaccttcgctagtggctttggaaagagctttatttagggcgtcgaatcctatttttccatcgctcgctgccttatataatgcctctccagctaaaccagcttcttctgccaaaatgtctgtaatgtcaacacccgcgtcacgaagtgcatacaaatcttctaaattcacttgattgctcgattctacacgagaatatacttcggctaatttctcaagcccctcgctacttccaccagcagcctccccaaacattctaattctctcttcaacttcactcgcagttgcaccataagaaagcattgttttagtagcattagcaatagcgtctctagtaaaaagagtttcatcgccaaaagccctcatggattctgctaaagattttccaaggtcttcgtttccaagcatgtcagaaaacgttgacacttcttcgttgaattcatcaagagcatccatagcgccatcaaaaattccacttattgtagagccgattgcttgtatagcctttacagccataataattggggcaaaagccgccaacatttggttgaatgcctcaccagttttgtttgccaaattctttacacttcctaagccttttccaacactttttagaactttgcctatacttttcatgctgccagctttggaatttacggaattaacagaatttgcaagagatttgaagtttttaatagcattctgcgaacttttgtttagcgctttctctaagttggatccagatttagcagatttttctaattttgacttcaaatcatccagacttgaaaatttttgttcggcaattttttttagagtttctgctattgcgtccagcttttgattattgctgatcgacattgatagcggaattattatttcatcaagtttcatctacttctgctctcgctctcaagatttttgatgtacaaattgagttcgttcaaaaccaaaacaaaccagtaattttgctcaaaaaggccgcccctattaggcaagctgccaatactttttgaaagtaaggcttgatttagtaaatgcagaatagcatcctcattatatttgatccagggaagttcctttttcatattcactatgaattctgaattcacgcgatctgcaaaattcagaatttggtcatagtgatttttttttgtaatataagagaatgcaagctctacttttttgaaacacgctcaacccttagagtatctgccagaaaattaatttcgattgcaagacttgaaagcatgtcttgaaacaagatagcgtcaccttcaaccatctctttggtgataacctctccttgttgattttcaagaccgacgaatcctaccacattttcatcccaaattttttttacaaattgaatttgagcgcttgttgactcaatcatagcattggaattggttttaccattctcgccattcaattttttgaaaagttcgatttgtcttgcctttagattttccacaaacccatagttaatgtctttcaaaaccacatatgctttctcttcttctttgatcttttccttgccgtttctaatatagtctgggatatagggtaacattaccctgccagtcaaattaacattaattaccattgttgcctcctaaatcttgaagaaccttgcatctttaatatagtcgcatgaaagggatactaagggttttgtcagagtaagctggcactttagatcgattttttgattgttcaagtcctggcttgggttgtaagttgcaatttgtccttcgcccaccatgaatttggttctttgatcttgatctgcaatttgatctacaaaaagtaccgtgaactcgtaatttgtaggcaaactgcgttttccaatttgccattggtcattattttttgaaatatcttgtgttatgaaatgcgatttttctatatatgtatctaggatttcttccttattagttgcggtttctctaacggagtacccgctaaactcaacagtttgctctggtatttttccaattgccgagattgatccgcaagttgtttttagagtttctgtagcttttgttgagctgatggtatatgaataccctaagcaatatgttttgaaaagtagaacatcaatttcatcagcattatcacatgcagtagatatttttgtcaaaagatctttgttatagtagaaaatactaccttcttttagatctaaatctgatgtaagttttgacttagaatcaatctttttaaccctaaaaatgcattcgctaattgacttccatttggtaggctttgttatgtttgagcccaaatcttttacaactaaattagtaggatctgttccagaaggttcattattatttttaatgtctgaacccttgaaattccacttgaatttttcaatattgaccgtaactagcactgcgccagtcggcattctcaatttttcaattgccatttttacctccacgacaattaatgtaatcagcgccatctatcctaattcccaatgttgaatcaaccaatgttaccattcttgcatcagaattttcgtcttcaacctgggaatcgtcaatgctaaaatacttcaacgaataatttagcattagaaacgccacaattatatttgcaatctcaagccctaaagtaggacgcatgctacactctgtgtaaattatgaactttggacacaaaagcatcgagtaatttttgcaatgattcagaatttctccagtactttttactgcaaagacaattgatggcaagtctaagtttgaacatgcaaacatttcagacttgtaatatacttttgtggttgtttgtttacaagtagccaagtaagttttcaaattctttttcagattaatgacaaattcttctatgtgcttcatctaagtaattttgcagactcctttactaaatcgcttgtccagtttgtatattggtttttaggttttctcttcttcaaagatagccaaatgggtactgctgaggattctatacccttatatgctgcccaacttttgatttttgttagacttggagctggcaagttgttgttatatgcctgtcctgagtctagaaattcagaaagaggggagcctacctttacttttaaattaattcccaaagaagtttcttctaaatcaatatttgttacattcgacaatcgtccggggatatgtgattttaaggagtccgacttttgtcggattttaaaaccaacgaaactttttgcattatcaaatatagattttcttattttttctccaatttccatttgttatccttttggtcaaccaatataaagaaagggacaagaatcaatacgagggaataggaaatcaagttgagagagcaagtacttaaatttacactctttttgatctcctttacacctaatattgaaaacttctaaataaagaacatcaagcaaaattacaagccaattattgtaagcaactcccatttggtacaaggccaaaatagattttgcatatcttagtacttcaaaaagttgcacttttgtttgatctgggatactaatgtttccgtcttcattagtgcactcaattcgtaaagattctatcttagtaagattgatccacataataagatcgtcaagttcactcatttgctaagtttgttacccattaggttttgtaacttcaatttcaataacttcttgtggttgaaagtgaattattcctgctgattccattgaggcatgaatgtaatctccgtctgatgatgcaaattttctaaagaatatttctgacaacattggaacaaacataacttctggatttggttgataaagtataggatttttcaatcctttgaaaaccgaagttaccactttatgatctctaaaaagtgcttctttaactgttacatactgaggttcgctgtataactctaataaaaggtgagaaaaattgtgaggaactaaaagatggtaaccctcatcaagtttttccatgtgtttttctgcttcacgttttgcaagtgctactttttcatacaacgtatatccattagtaagtgtttcaacagtaactttacttctgccctttagatttgcaatgccttccatattgatgttttttttaccaaaaataacagaatggtatgcatccttcataaggccaagctctagattagcctttacttcgtcttcggttatagttccgtacattaggtcttttagagaaattcgctgtactgtatcaaatacgtgcatcttgtaagccatttctttgaagaaaatactactttttccaatttcattgctatgatcaccaaaagttgctgtgacattgtggtcaactgttgcttttttgacaatataataaccttgtcttagatcatttctacttatcatcttgtaaggtacaagctcggaaaggccaccttttgcaagttgtattatatctgcactgtaactaccacttgcttctgcaaaaatacttctactcaagaactacctcctattttttcacaaatttttacgttcatgcaaattttctgttaccattagactcaaactcagggccaatattaacatcaagcaaaactactttgctatttgcatcaagactaacatctttgattctcccaacttgcacaccccctttgccgtcttttacaagtttccccccctttaagaagacaaaatcaccaattttaggagttgcaaatgtgttatctaacataacggttatttccccggcacgtcttattggaattagttcgcccggtgagtaattttcactttctagtaaagcaatatctgccttttttaaggcaaatccacgaataggaccaactcccgctgttgcagttgcagcctttaccagtacttctcccatttcacttgatccacttgaataaactggatctcccggtttgatgatgggtgattcaacatcaactattgcggtttcagtttgatgtacgcatgctttgtgttcaactcctaaaacgaaatttttacataattttgtaaaatcgaaatctgccatttatgccctccccaaagcaaatctatctttgtatttttgtaattttgtctcgttaataatttgacctgtaaatcgatttcttgcatttaccatttgcttgtacgctgtaagttcttgtactagcaagctgatattgtcgatttgcgaatcaaggtcaccttcctcgtcaattttgaacttgatgttgtacttttttttcattgcatccaaaaatgcaagcttagcgtcttttacgctcagaacattagcaaaaggtggagcaatttcatactgctcacaagctttctcaagatttgacaaaattttagaatctttgaaagcattagcttcggcttgcctttcggcttgttttcgagcttttataaagttgctctcagcctcagcaagtcgtttttcgaaatcttctcgtgatatcatgtctggcaatttttttgcatcagccactaatcgttcatattcttctgaagatattgttacaagttctttgtcattttttggcaaagattcagaaattgcaacagtttcttcatttatttgttcttgcatattgacctccttaaaattaaattttctaaatttgcaagtactgattcatttcatcttgtatttttaaatacaagctatcatttcccatttctttcgccttacttaaaagttccacataagttgctaaggtttttgcatgtttttcatcaatttcggcttgttctttttggctaattggttttactggcttgtagcaccaattagagcttaatccaaattttgaaagtaccgcattgatgaatggcgttaccattagtttgcatatctgctcaatgtttaggtaaaaaatatcatagttgccaacgctgccttctccagaaggagatattggatacagtatttctttgggaattcctgaatgaagtgttatgtctgatacaatgatttcaaaagcatcttttagtgggcttacagatcttgttacattagcaatatcatcttctcttccgagtatcatcattttgtggttactatcaagaaccccctcaatgttttttttaacttcagccagatcatatgcagtcatatccttgactgatggcagagttgctgatttaaggaaagtaaaattatttacccttaaaaaccctaccgtttcattaagtagcgtgttcataatattgctgcttttttttagagactcaaaatttagaaaagaagacttcatggtaatgattctgctttcatgtatattttttaagaaataagatcccccatcaacaacttcaccaaagttatagcaaagacaaggaaaccctttttttagtggcttgtgtggatcatcggaatctggaactactatataaaaatggctttctccagacaaaattgctgtataaaccatttttttgatcacagctctgaaattattatcaaataattttgaaagtccatcatcgactttgtgctcaatatctcttgaagatgcaaaccccgcgtaaatttcagctatttgatgcgcaagccttaattgatcctggtgtggtgtgtattcacttactggaaatagttttgtttctttaggttttttgaaaaatttcattctaaacattagaagctcctttagctaaaaaccgatatggcattgagaaatgccgggatgtataccaaatctttttgcataacaaaatttgtaacttcgctatcttctgcactagattcatcataataatattcagtttcgttgaactctgaaattacatcagtggtttcgggtttgtttaccacattaagattagacggaatcaaatagtctgagagtgaatacaagtttcgtttttttgcaagcaaagtacctctaccaaaacgagaaaatacatatttgagttcttctcttgctgttggcaatacaaaaacccctttaaatttattaatttcggattggtaatcagtttttgatagtaaaactttactacatgcgtttgtaataattacaactggaagataggaaattcttccaacaagaatttctaaaaaacaaattctgttgcctttaacgtgtattcctgtataatagcttccattagctctggaaagaatttcgggaccacacacattaaattttttaattagccttgctgtaccaaaatcaaactcttctcctaaaacctcaattctaaaaccaatgtcattgccatgatatgcaagtctttgtttttcaagccaagcttgtacgtctccaccatttaaaaatgggttgtcacggtaagtgcttttgattatacacacagcaggattgtcttgatttgataagtaccttttgtatagccaatgtgatttaggcaccggattgcttgacatatagattctgccgccttgttctctcattgtagggacaagcatttctatatcatcagcgctaaactgattggcttcttccagccataagtccttaaaatgcgcataagattttaaatctcttgtatcatgccccccttcaaaaacaaaagcacgttttttcccaaaaatcaaactcttactttcaatttttgctttgcttatattgaaaaattttcttaagttgtatatgcttaaaagttctaaaatttctttgtgtattgattgtgttgttttgtttttcttttttctaattgcaagggtatctccgccatcagcactaaattttctttctaaattaacagttgcaatgtcgtaggttttaccagttcccctacttgagtagtatatgaaaatttcagcattgggcttttctttgtaggcatcaacatatactggaagtcgccttagtctcatagttcacccttgttaataattttattgatttcttcttcggtataagaacaactttttacaaaattcgtacttgtattgtttccaataattaatttttctttgttaataatgtctagcactaaatcttcagcttcgctcatttcaaagaccgcaaaaaacattctgaatgcatgtagacttgttgctaacacattgctgtttgaaaattcaaacattttgttgacaaacagtctaagcaacgcttgtttgctggaattgtgtacagtttgattatcaaaagaaagtttttcttctattaatttttttaaattttcttgaatttgtaaattgtccataatttttctcctaaagatcgtatctgtaaaaagatatatagcaagtgtttttaggttttgtttcttttgaaccactttgacttgtgaaaggtggtaataaatattcggggtctatctcttcataactatagcctgtaataaagggagacataatctcctcagcccaataccaagtataccaagtatcagcactacgataaatcattgtcattctttttactaatttgcctttaaaattaattctactgaagtcaagatcatgatcgtgattcttataagaatcttcttgtgtatgccctaagcttcttgtaccgtcagaatcggtggagccgccagaatcatagtgtctcaagaatctgcccgacaacttgggtgctgaagatattcctaaaactttatatgcgtagcaattgcttggcaagcttcttccgtctggaatacaaaatttgtttgtgtttgtaaatgcttgaatcaatttgcttcttgtaaggattgatccttccattgcaaatttggcagtcaaggtacctacgggtgttttttccaagaaaaacaaaatcatatgttctaaatattcaataagtgaatctaaacttggtgcatttttagtaatttcatactcttttctgttatcaatgtttttcccatcgcatattgagaaagtaagcttatcttttagcaaaattggttctccaagagagccctggtatcccagcgagtctattttatttccatttctgaattggattcgagttttagtgttttcgagtttcttttttatttctgtgtagtcttgttgtgttatcattgattttacctaccaatcatatctgtagaatgaaatataacatgtatttttgggtcgtgtttcgtcatctccactgtattttgtgtaggaagggtatcgccacgactgtattggttcaccgtattctatatgagtaacaaaagaggtggagcctgtactccaattagaatctcttctgatggaggagtaatcagtcacaagtcgccctcgcagactatccaatacgctcaagtcaagatcatgatcgtgactcttataagaatcttcttgtgtatgccctaagcttcttgtaccgtcagaatcggtggagccgccagaatcatagtgtctcaagaatctgcccgacaacttaggtgccaaagatattccaaacttttcttttacaaaacaattgtctgggagaggtcttccatctggaatacaaaattttttagtatcttcaaaagcttgtaccaacttgcttcttgatatagatccttgctcgacgaattctgcagttaaaaatccaggataagtgttttctaaacaccaattaactaagtcttttaaataatcatctatattttcgccaatagggggcttggtattcttgttaatgggataatattttctattagtagtatctttaccattgcaaatagcaaataattctttatctttaacaacaataggttcgccaagtttgccaacataattttttgcttcttccatagttccaacgccaaattgaattttgatattgtcggcttgaagtctttttttgatgttttcaaaatcatcatcacttaacatctaagcaacctcctgtttgtctttagtgttttccatgtaagtgctaagatcaagtgttcgcacccctgcatttgattttcttgctaaattaagggcaagtgtgttttttacaaaagtatcgcgtacgatcaagtcaaaagcatgattttcaagtccaactttattttctgtaaacgtattgttacttagtcttgcgctagtaatatcttgtaaatgcagcgcagtaccgctatttttgataaactgtgtgtcggttattttcaaacttgaaaagttggaaagcttaagcgcattggtgttgttggtaaagaagctttctctaattattgcattaagtccatttgcaactgatgcagttttgcttccttgagcattaacattaattagtgttagattggtaacattttctatgtcaaaactttgatttgtagaatcaaaatttacatcttcaagtaaaattttttttgtttttttgaaatgcaatgctttgtttaatgcgcacgtaaatgtgacatttttgatgtacacaaagcttgcatctgtaacatagactgatgatctggcctcttcttgcaatgaatatgatgagcagagcactacaacagcgggctgtgtaaagcttttgtcttctaggtaaggtgccagttcttgttggtttagatctcctccgttaatgtaaagttcactcattggttgttgacatatattgactccagaaagcctgaatgatttttctgatgtaaaaatatgtttagaaaaccccgtgcttcttatgaaaacttcgtcatcgccttcgatttctaaattgtttagttttacttgatcataaatgtaaaaatcgcctttaagtagtttgatcttgttaagtccagcttgttttgcaaattcaattgaaccatttaaagtattttcgtctttaaacccggaggctttaaattggtaagtttcggccccatcataattaaacggtgcaataacaactttgtgagccccagacaaatagtcgcttattcctattttggttgaagttgtaaggtattcgtaatgagtgtagtcaccccaagtgattccctcgtactcgtaaagtttgatatccagatcgaaattagtaattttttttgaaagtataaggaaaaaatgatcaatcccaatattgtcaagtctaagtttgacaaaatcggttatatttagattctgcattgacctaaaattaacaatagtgtgtcctttgacacgtaagtttgttaggaattcaaaaagtcttaatgctgaatcttcggaaaaaatgaatctggttgtgtattcaaactttttagagtaaaaatcatcagcattgtcggtttggagtacattttgagctattgtgtagaaaacatcaccataaatgtcaaagtggtaaatatatttggagccttgactactagaagtgtttctaaaccaaagcttagcctttgttggaaaatattctttattttcaagcttgatggaggagtcggcactaaaccttacttcaaggttatgagttgagattattgctaaatgttcatttatggcgtagtggtcgtgccaaacctcgcgccttttgaagtcccatttgtaaactgtatctaaccagctaggatcgtattcttgaaaaacactgcttccgaccttgtctgcaaagtcggggtacactacgcctttttgaagaactgcaacgtacagtgcaccatcggtaccagcaacattgattggggctgagtacagtggtcgttttttggacattgcttcttctttgctttggaatttgccttctctccaaataactttagttgaatcgtagctactggagctactttttgacataacataactttcagcatccacagtacaaatttcaatttctttagtaataacttcgcttttccaaattggaagtatttgtagtttgccgactgaagagaaagtgtatgcgtatccgaattcatacaacaaggcttgcaaaatagtttctacatcttctccagaatcaatgattacagcggggactttgtcaagtattgcttcgctagcatcatcatcaataaggtcttttagtttagttttttctattattagatggacaagtgaaagttcttttgctaaaggattgtatacaaaaagccagtctggtaaaaaattgattgggaattgaactggattttcgaatgcaatctttagtaggctagagtagtcgttaacggtgaatgatacacttttggtgctattgaacagatctctgctgaaaaatttttctagaattcccctaaaaacggggttattcttatcatttacttttacgaaaatgtcttcgtttctgaagaataagaaattcaaaaattcttctgataggccgcttacactaaagctgaacgtgcttgctgctgtttttaggcttggatcaactattttttcttctagaacaatgcttgtagtgtcaacaaaaggggtaagttcaaaaatttgaccctcgtccgtgtagaatacaatatcaagccccaaagaagtacaattttccgatgtatcttctttgggatttgagatttcttcagtttcggcacctttttcggtttcttgatttaaggcttcggattcttgacttgaattgtcttgatctttcaacttaatacaatccttatcttctgctgtattttttgtaacacccaaatacaatcggttcggttttttctatgtatcgattgtagtaggtaattcgattttttagtatatttgtttctttagttccattttcatcgccaaacacgggatcaaaattttcaaacacaggaaatttgtcattaggatagtatttgatcacataagattttacagtcaaaagccaaacatttagtgcggttgagtatctaaaaagttctgcttcatcgagcattaaattttcaatatcttctttgtttgttagggttggtttttggggaagtgatggtattgattcgcaagaaagaaatagtaacagtagccaaaatatccctaaaaaattaatttttgtctttaaatttttcattatttgcccccttgaacttgattttgtaaatcttttaacattttgcttgtgacttcgtctctaagctttaaaagctttttgtattctgaaaaatcacctccagaatctttgtaagctttataagcttgtattgagagttcaattgtatctttgagtcgtttatcaatttgctcaacagctgcttgatcttcattgtttttttcgattttgtctttaatgtagagtatgaatttcaaaagtgaacttgtaaatgtcattccttcgtttacaatatctaatttttcgctaccaaaagaactttcaagtccctttagaagtgcatttttgacgtctactgcgtctagtaactcattaatgtttttaattgcgttcattacgctacctccaaattatttctaaattttgcactgtaaaattctagtctatcctttacgcgctctaaaattgctttattttgaattttaaatgctcttaaagactccaagtgtccgtttgaaacagttttagaattgccaagtgaatcccaaatcacagtttttaggtcactgtttaagattacaaaatggtaaaaattagaacttgtgtctttgtacttaccaatcaaaatatcagattctgatgggatataagaggttggatgatgtttttcttcgaagaaaatatcttcatcaatacccaagtttgcaaatattgcatttggagaattaacaaatgcattgtcaccccttaggcagcctttacttacaagacctttgaaaagtaaatcaatctcaaaacaatcaaaacatttttcaacgctgtttttgatttcttttaccacaagtccaataaataaaatacaaagaaaataacatccaaattttgaaataacctcattttgttctttgaattgcatttgcaagggcacggcaattctgtgaatttccacttcttttacagtttctttgtaagaatttttgaaacatgctgcactttcgagtaattccgatttgtacttttttataaagtagtctttcaaaagtttgtagaaaaaattgtaaatgcataaaaacattttgttattcatttgctttctccaagttttctaaaatttttttctatttcttcttttagaagttcttgtattttgattcgatcttttgagaaaatatttctaacttccaatatcaaattttctttattaaccgcgttaataaattctgtagttctttttagttcttcttttagttcttctttgatggagtttttcatttcttcgaattcagatttaatcttggcattgtagtaatcttcgagttctttaaagatttcgtgtttggcttttaggactgaagtttttagatcagccatcacccctttaaaagcgtatgtgccaagcccagagatagatattactagcattgctacaatgctgccaataatatttatttgtttttttactcttgtcatataattcctttatttttttaaatttttaaaaaaaccatattttacttattttttaaaaaataaataaaatatggtctagctagactggattaaaaatccaagtgttatccaacaatgtcaaaactattacattattaggtatttcgtaattgtataacgtttttgctaaaaatcaaaaaaccaaaaattttttggatttttttaagacaaaaaacacgaattgatatatactttacgtgcatggagaggcttattttttaggaaatgcgtcttaaaaaaaaattttaaaggaaaataaagtttaagtcgcgctgcatgcagcgcgacttaagcctcggacacaaaataaagtttatgtgtaagaggatatgtaaacatatatgaataaaatattattaaataatgctagacttagtaaagtgttattacatgaattgcttaccaaattggtagctttaaacagtaaaaaagaacactgtcctaacacgattaaagtgtctcaagttgaatcactgatcaaaaaaatgagatcaaaccaatacgataggcttttaaaggtttattgggtgattgatgtcaaaaatcaaaattacaaaaactcttgtggagttgatcgttattcggcgtgcgatatttatagactggttgctgatctgctcaaaaaagatggcaaaaaggttgttagtgtgcgcactgtgcagcgggatcttaaactgcttaacgaaattggcttgattaaaactaagttaagaaagttcggtaataaggacaacaaaggaaaaggaagcattgctcattatatacaaaatactgagcttgtagcttatcataaggaaataatttgggaacatcttgttcaattactttatgaaaagcttgagaataaaaaaatagttggtgattttgacgaagacatcaaaaatgcggtgtttaatgtttctaagactgctaaattttataatgctaacaatccattaaaggatctttccgatacgtccaatggggcctctaatttctctaacaatttttcagataaattttctagacattcagaaagattatctgaaaatatttttttgaaatcttcatgcgacactgtcttaactaatcaggatgttgacagtcgcaccacaatgtcgcgccactcgccaccggctgtatttaataaagctaatataagctatagtaattataagaattcaaagaattctttatgtaattcaaaaattcaaaaaaacaatattaattttgaaaaaaaagatattgagactaaattgatcgaaaggaatatcccaaaggattttcttagtcgcataaaagatcttagcaataatcctacaacttacaaaaatgcactgtataatctggataaggccttagacgagcacaatgagagtaatttgaagtatgtgcttgaacactttttggatcagttttctatttatcgatataaagtttggatgatgatgaagcgtagggatggggttattagcgattatgaggtcatttggaaggaaaggtttggggagtttgttaagaaaaaagttgagcttaatgattatgtgaaaaaagtgctttcaatggaggctagagaaagagaacagcgtagtagagagcgtttggagaggattaatggtcaatcgcaagcacaagtgcaaacgcaaacaggagaattgtcaaataatcaggagcaagatagcgtaaatacgccgccggagagaatttacttaggggagaatagaaataacatctatggaagaagtaacatcgttaaggattccttgggctttaagacaattaaaggaattactcttgaaagccttggaattgataaaaaagcaatttaagcctaggtggctttaggaggtaaaatgagaataagaatgaaacatttagtaagaaggctttacttaagaagggacaagatttggcatgtttacagaagtacggaaattcaaaacaaagctaaagacaaaagcattactaattttcctaaattagaaccagaagattttgactatgagtatatttacaagttcgtggatgagtggattcagaagaaatacaacgataaattagggtttaccatccaaaaggtagatggtcttgaatatatttgtaaggcaaaaaggtatgcaagtttaaagaaaatattggctaggattgtcaaagactataaagatatatttcttggcaggttgcaaaagaatgttgctggtgcacaagcgggatccggggggagtggaggtaaggggagcaagccggcgggaacaggaggataatattagttcacaaaaataataaggaggaaaatattagctttagaatagtaaaaagaccagtaaaacccgcaagttctgaaaaggttgttgaaactgataaacagcagataccttttcagaatcattctttttttaaaaaggaaattattggcgataaaaccaattaccatacaaggttgatgaatatttataagggttgtcgggcctataaacataagttctgtgcttattttataaatacttttagcaaagagagaagatttattatgctgtaccccataaaggagggagatgcgtttttaggtatattttatgggtacaataaggttaaaaataatccattttacagagattatacttctgtttgtagcttttctaagaaaatatttaaatcttttaacaaatcgtattttattgaatttagatttaaaaaggggagtgtgtttttgtatctccacactatagcttatttgcttagggatagagatagctataatagggagcagaaaaaattacatatgcgtctgatggagctagaaaaaggagtatttaagttttatggtcgagatttgaatccccagggcgaaggtattataactaagtggatagataaaatcaatcagaaaaagttgggcaaagaggataatcctagtttgcttcgcagtctgctacgtagtcgactgcgtagattttgaatttacaatgttactaaagggtaaattatgaaagtcgctagtcttataaggtcaacttgtgaaaatgaaaatttaattttgcggagcggatttagagatcttgatgctattatacaaggctttagggaatcaaattttgtagtaattggagcacggcccagtgttggtaaaacggcttttgccctcaatattgctcacaacatatgtttagaacaaaatttgagtgttggatggtttacatatgaaatgacaagtaaaactgtcactcggaggcttttgtcgatgaattcgggcatagaacataataagttgcttgacaatatcagttcgctaaataaaagtgaactggacgcttaccataaatcagtttctgaggttagtaatttttctttttggattaatagcgtttggggtactgacatacatgagttagaagataaagctagacaaatgaaattgaaccacgatgtaaaaattatctttattgattacattaatttgattcccgtgtcacagaataatattcctcgttttgaacaagttgcatttttgagtcgtaatatacgttcgcttgcacttgaacttggaattccaataatagttgtatctcaagtttccagaagcgctgaggttgtagaacctagtttggcaactttgggagaatcggcagcattacaatggcatgcagatattgtaatttttttacatcaagagaggaaaaaacgtaaagggcggaatacttctaaaggtaataatacaactaaagtaaaagtgatagttgctaaaaatagaaacggttatattgggattgccaatttaggttttactccaaaaactataaaattttcgaattgaaatttagatttgttagattgttagattttgtaaatattctgttatttggccttaatttgtgttacaatgtatttagtaggtgagtaaattatgaaatcatcagtagtgacaacaagtattactgaagagcaaatatataaagagtttctgcgactaggtatggaacaactaatagctcaagatttatcaaaaagatattatcacaatgaacttacatatagagatttagaaaatttagaaaagcaatttggcataaagtttgacaatcttgttactaagattgatactgttaaaagtgaacttactactaagattgataatgtagaaaagaatttacaaaaggatatatccaacttagacgttaagattgatactgttaaaagtgaacttactactaagattgataacgtagaaaagaatttacaaaaggatatatccaacttagacgttaagattgatactgttaaaagtgaacttactactaagattgataacgtagaaaagaatttagatactaagattgataacgtagaaaagaatttagatactaagattgataacgtagaaaagaatttagatactaagattgataacgtagaaaagaatttgcaaaaagatatgtttagtttggaacaaaggctagaaataaagctggaagccaataacaaacttcttttggaaaagctggaagccaataacaaacttcttttggaaaagctggaagccaatagcaaagttcttttggaaaagctagaagccaataacaaagtttcttcagaaaagcttaaagtcagcaacagaatagttattattgcagtagtagttgtgcccactgctatatctattctaactcccttcattacgtcattaattagcaattatttcaaatagaaattgcaaagaattctttactttaatcaagaaaaaaaattttagatataatgcgcttttgtaatttgcaagtatttttgtagattcccagtttttttaggttagcattaatgtatagcgttagagtatgtaaatttttgcaaggttccttttcagcaataaaatttgaaatcaagtttgtaatagtagatttaagctcgttggagctgtttttataataattcagattgttttgattgagctttaaaggtgcaaatgatttaatatagttaagcttttgtgatagatttaatatgcacggcgtgttaactaaaaagatgctttgtgaattagagttgtgcctaacttcatttggtgtttctttagactttgcaatcaaagagtaaacaattctcagttgtttagtagtaatgtcaaaaccaaatatcttttttgccacataattaattctggttgtattaatagatatcaatctatttttgtctagattttcaatacatctggaaattttattagagcaaattagggaatgtgtttgaatttgtaaaccgctgtccaatgtataagaaattgtatcagattggaaattgtaaggagtttttatgttttgatttttcagatgagttaatggaattccagcagccataataattccaagtaaatggtgtttagtgctagaagaattaataagattctcgctaattaaaataaattcattcggatttattttataaatttttttttgtttggcaaatttaccttttaaaaaaaaattgcataaaaacatataaacattatatacttttttgtaagaatttcaaaagaagttataaatttgtaatttggagataagatttggtattcatgaaacatctaaattaaaaatttgtaatttgaggttagtgcctagggtttttggtttaaatgttaacccg

SEQ ID NO: 205 - DNA, 28601 bp, Borrelia burgdorferi
cgagtattttgactcaaaactttaccctttaaattgctaactttaacttgaaaatactaaactttaacccgaaataataaaactttaactagaatttttcaaaatgataaaactttaacccgaaatgataaaactttaatttttgcaattttattctcttgttttttttaaaacgattagaataatcgttgatcaggtttattgattatcaataaacctgatctataatattataagcggtttttgcaagtttaataggagctataatatccatgaacaaattattgatattcattattttattagtcttttcatgtaatttaagtaattctgatcaaaataatccactaaacatgtcaaataaagaaaaaataagcgaatatcaaataaatgagtcgtcaaacaaatattcaattttcaaacgaaattcaagcgttaaaagatacacgttcaaccattattactaaccaaaatgataatattaattctactattaactacccaccttatattcaaactatcttaaaaatagaaaaacaagttgacggaaatattaatgggatgactaaagaaagtggcacagaaactaaaaagcttttagaaattctaaatgggaatatttctcgatttaaagatgcaattcaatatggaggaagttttagggctaaagatgttagagaaaatcaaacccaaaaagaaaacaacaaagactcgcatattcatgtcgacgattttaaagaatacatacatttaatcatgcctagcattaacaataatgctgatagtagtagtagttattactataccaactacataataaatggagacaatttgttaagaattattagcaacttataaaaaatctttataaattaccaatattcttgacaattttaatactattttttttatatactataatattatgaaaaaaaatcaaaaaaacaagtgctcagaaatagaaaaaacacaattagaaataataaataaccaatcagaaatagaaaaacaactccatcaattagaaattgagtttactggggtatgcctgctttatgtgacaatacattattaaatctagaattgaataattattctcaaaaaaaactattaaaattttacaacgaaattcttaaaaaagataataaaaattcttgcgatctaccaacaatgaataaatatcttgatatattagaaaaaacaaaaaccatagtaaaactatcttttaaaaaccagtccaaatatatgatttattataaaattaattacccccttaaagtgtttcgttcaacaatacaagactactatcaaacaataacagataaactaaaactacggttagaactaaactatcctactactatttaatcgtaaaaaatatttctttgcaaattaagcaatttagaaatataaatgtaaagacatatatttttatttgataaataataaaaattactggggcactatttggaaaaatttttaaaagaaatattaagtatgaatagcaaaaataggctatcttcacacttaataattcttatttacacactaaacaacattgacctaaattcaaaaaatattggatactatagtaggggctttatacgccgtgcgtttacttttaacatagataaatactccagtaaactaaactacttttacttattctttataaaatagttattcttatgatttatatactccagttcttatggaaaatattgtttcttatttataattaaatgtatatgctccagtaaactaaaccacttttgcctattctttatgaattcttcttccctatcattcaaaatgattaaatctttagatacgcctaacccttatatataaagaagattaaatccacgagagagtaagggtctttagtaaggctggaattttggttttattattaaaagattttttatttaaagaaagtgggttttgattgttataacttgatcaagtagttcttatccatgtttagagagattgaaaccttagtaaaaggtaattttgattaatgtctttatactatgtgccttatataagcaataatattttttaatgtaataaggagagtatgtagaattattttttagaaatttttaaaaagatttggcttttctattaggttaaagtttatagcttttcaaatagtagtactcaaaagagaagtatgcaaagtatgcttttaaaccaagaaacatgcctctcttttgataaattggcttaagccttaaatttataccttgtgatctataataaagtttgcttaatagctttataagccccctcaagttctacagcagcacctaaaaaatctgcttcttttttataaaaattattatacctgcttcttgaatttatttccctatcattaaccatatctccaatagttttcacaatacactcaagagctataagatcattttcctctacaaactctttagctttattgacaaattttttagaagcttcaacaaacttactatcaacaaacttagaagatataacatcaaaactctcaatgtaggctaatacaacagattttctaagttttttataagaatcagcaacatgtctggcattagacacatcattatctacagcttggtctaattctatagcaaaatcatcaattaatttacttaaaaacataggtttgtattcttctataatcttttcaagctccttaaacttattaacaattttattgtcttttttaaatatagatatagcttgattaaccttactttgatcagaaaatgtaccttccgaataagtcataatatcattatatgctcctgtacattcgttataaatagcgtctaattttatagaataatacttggccttttcaacaaaaattttaagctcattaatatttctctgatttaatctactaacatcacatgataataaacttattgaaattaacatgtatattgataaaaaactttttttcatattttctcccctgctaaaatctttagagattcatagcctctagcacaagtatattgctacaaatacaattttactatatctttaattttttgtttcgatttttatatattttttaaaaaaattgctttatctttaatactttatgttctagattaattattctctctaatagactttgagcatattttttttaaatttttctttttttattaaaacatgaattgcttttatataacaaaaaacacttcctttcttaaatctaaattctatgtaatgaattttatacatgggtacagttttgatagttttttgtaataatatcttcgtatttaaaaaaagtggtcttgttaatcttttaaatccataaaacattcccaaaaattcatcattaatactttatagaagttattgatattaaagatgatttagaaaacttaaaaagctatttcaaaaaattgaaaaaacatatcattattggaataatctttgttataattcttttattttttaatataaaaaataaaaagatattattaaaacacattataagaaagatacctttttaagtaaaagtacattttgcaattaacatataatttataaaaactctttttataaattacatattaattgctaaatcatcttcttttgctatatatgtaagtaaaatgctaccaatatgacatcctgaggaccttttatggagacttgtaaagctttttatttctaatgttttagcttttataaaaacaccaaccatgacacatattgaatttttaaatctataaacattatttccttaaatttctaaaagttttttaggctctgtatttaaaaaaatcacttcaccaagaataaccttttcatcatttaataataatgttttcttgctaagaaaatttataaatctatttaaaatgcttaattaagcttatttgttttcaaataattctcatatccttttattaaaaacaaaatgtattcttctccctttttattttttagcacctcaaaatcattaagcaaaacctcaaaatcttctttggttagcgaataaagactagctacaataaagttattttcattttctttttctttgaaaaattcatctttagtgtctaattttagaattttattaactttttctttgctaaatttaaaatgctctaagtaaagcaaattagagaaatttaaaggatcatttttagctattaacaaggaagtgttttttactaaagttaagtatatcggattagctaaaatttcttcttcttcgggttgaggcatagggcattgatataagcatgattttacaatatcagtgcttaaagcaaatcttcttattaaatagtcaaaaacaaatgaattaaaaatagatataataaataattttttataaatagatattggtgttttctcataatttatatatattgtagaaacacaataacaatttctaggagataaagtactaatcatggttcttatatctgtatttcttgcaatccttctatataatattttttctatttgatactgattgtctttagttgatactttttgaaagtcatctttatctatccatagtaatttagagctttcttttgcatctttgtcttcaaaaaatcttgaattaaactgatgaatattagctccagaataaagaaatataaaattttcattattatattctttacatagtgttttatactttgttaaatttagccctactccaaaattaatatattcttcactaagagtactaaatttgctaaacattttgttaattaagataagctctttactatctttaaattcaataattgattcttgaataggagacagttttttaatttgctctatatctaatttaattcctttataaggatcatctttattattttctaagttactggttatttcttttaaaatattatcattactctgaatcataaattttgctttaaaattcgatgtaggagttttagtattgcttatttgaaatattgcaaatttaaaaagtgttgccacatctttaaatcttttttgattttgaaattgataaatatagttaagcttatagttagtaaatatatattttcttagtatcctagcactagattcactccaaagagctgaaggaactaaataggttaaatttccgttttcttttattaatttcaaattaaatgctacaaaatatctaaaaagatttggatcaccaccactagcaaaatttttaaaatcgcttttataaagattgttgatagtacccatactatttttttcttcattgtattcaatattcaaaggatgattatctctgccaagtatttcttgctttattttattttgttcttttatgcttagctttctataactgggaatatgttttgagaaaaactctgcttcattaaacttagttttttcccatggaggatttccaattacaatatcaaatccttcttgaatatctggaaactcaattccataatggaaaaatttatagtggctacttaattttctaattttctccattttttcattatcttcactagaaattttattgcctaaaatattctcaattaaactaattacaactgcaatatcactaaattctatatttaaagatttgtcaaaagataatgaataaagtttaattaaagaaaatattattcttaaattatctatatatttactttcttcatattctttgtatatctttttagatctttctatatcttccttagtggtatcgttaatacctttaattttttgataaccatcttctaaaatagttgtaatttccttaattctttttttaaataaagaaaatccactttcaaatttcttttttgcaatatcaaaaaattcatctttagtatatcccaagagagcatttcctgtttttatatgatgctcaataaagcttagtggcgttccaaaaataaaggtattaatccacaaacttagcatagtaatttcaaccgaaataggattaatatcaacaccataaatacacctctttagcagcatccttttaagcaccaattctttacttatactatcttgaatatcatactcctcactttctttaagaataatcccatattctttatcaagctctttttttacatcttcaaatttatctagctcgtaccataccttttctgttaagtaatctagacaagaaattaaaaaatgccctgatccacaagaattatcaatgatttttatatctaaaggggacttggttttaagctgctcttcaattgatgatataaccataaaatcagttaaatcatctggagtataatatgccccacttttctttctatcaagtgatctagatgtaagataaatattccctttaagatatgtagcaattttgtttactttattgttttcaagctcttcttcagtacgaatgagataaatcccgtcttcaacaatacgatgaacagtagtatctgcaattcttaggtcatattcaagtagagtttcgtataattctccaaagcttttaggatctagccttgaatattttacaaattttttatctttaatatttttttcttcaaagaaaagtattttgactaatatttcttcaatctcactaatactgagtaaactttcattatttaaatatttaaccttatcttgtgcaaataatcctccattaaatatgggaaactttattgcatcacttcctttatcaagcaaattgaaaattgttattatttttttataccctaatttcttttttgtattttcatcataaaaaaaatatctaaaagatacagaagatctgtataatttattttcttctaatattttcttaaatatgtcgttatcttcaatatatgcaataaaaaatattcttaaaataaaaataattgactcttcaagtatgctagccaaaatatgacgagtaatttctttgtctgatactttaaattctttgtcatatatattttttgcaattttaaatactatagaatcatcaggtctctcataaagtatctctctaagagttttttgaattatctctttttctttggatatttgttctttttcaactgatattatattgcttgtctttaggtatctttcttttcttataagatagctaaataaaataaaccattcttgctctttatattcttctttttctttaattttagaaaaatcaaattcaatatatcttttttctccataaagtactttcgatttatcatataatctccatacctttccatttgaaagtatcccataatgtttttgatattgatttagatatctgtatagctgatcttctgcttcttttaccttatctttagcatcaaaactaaatgatggacgcttaacttctgctataagcaagatatcttcagttggaatagattcattattttttttagcttcttctaattttttattaaaagctactttatctttatcattttcaaaaagtagtatatctactctggattttactccttctatttgcccacctttttgttgttctactgaataagctaattcttcaaatatagactttagcaaagactctatatttgcttctgttgaattgtcatctatagcttgaattttattttttaaaaaaataaaaaagttttttgatttaacaatattttctttttttataaagccttttgacagttctttataaagagatacatttggatcatttgtttttataatgaatcggctttcattgttcatatttacaaccattatgttatttataaatcctttttagcccttcttgatactcgaaatgtactctaagattagtttttttaaaattaaaaaaactaatcttagagtaagtcggccaaaacttgttttaatatttatttgactatcaatactctatctttagaataagcttgttaaaaattatttctcactttttctcaattaattaaagttattaatttattttttataaggcatccttaattaaagagcatttaaaaaacacttttttaaaaccgaatttttcttaaacattccccaatttgtgaagcataaacaaaaaaatgtttttatccttttcattttcaaaattacaattatagagtcttttgttaatttcttctttaaaaacatcttgctcagaatcatgcaagcaacaaagatgcaaaaaatttttaaaagaacttatcaggtcaaaaacaacacaaataataacccagtttttattcataattatcctctctcaaaattaaaaaataaatcaaagtctttgatttacaattttttattaagcagtgaagggggaaaaacaaattgtcctaaatatttaacaaaaaatggaaatagacttaataaacttggttttttctcaggaaggatttctaattacaacatcaaattcttcctgaatatctggaaactcaattccatagtaaaaaaatttatagtagccgcttaattttctaattatatctattttttctttatctttactagaagttttattgcctaaaatattttcaattaaactaattaaagctgtaatatcactaaattttatatttaaagatttgtcaaaagataatgaataaagtttaattaaagaaaatattattcctaaattatctgtatcttcacttttctcatattctttatatatatttttagatctttctatatcttctttagcagtatcgttaatacctctaattttttgatagctatattctaaaataattgtaatttctttaattctctttttaaataaagaaaatccaccttcaaatttcttttttttaatatcaaaaaattaatctttggcatatcctagtaaaggatttcctacttttatatgatgttcaacaaagcttaatggtgttccaaaaataaaatattttaataatctaacttatttttttgagatagttttttataaaacttgcccaagcaatctatactcttaagttcgggttttctcaatcacctataactttatttgctaattaattttttataaaagctatccttaaatttttcaaaatatactatatgaactactgcttaaaaagcaaagactataaaataagtagttcatcagaaagtttttgatggtattactactattaatagaatttaaaaaatcgagcttaccaatgtatttaaataaactagaaagcaaaccacaatacatgattaaaatgatatgggcaataaacttaaaaagtttaacgataattttgaaattcttattagaatctaattaaaaatgtaaatttatataaattttataaataaagagtcaaagaaaacgctttatactagaaagtctttataaagataataaaatatattttttagaactttcttcaaaatataaatcttatataaagaatataaaaaagaaaatagaatttcaaaatcattaaatatcgaatgatatttttaaaatatagtttgaggacaaataataatcgaatgatttttgaaaattaaattatttagatatttagatatggaaaaagcccccaaaggggcatctttatctgcgatgataaaccctaggagaaagaattgcctctaccctaaattaacaatagtactaaagtatagcacaacataaaaatacttaacaagattagattgattcaaactagactaagaaaatttaacaaagataatgttgaacatggaagtgttggccaagcataaagaaataatttaacttggaaacatcttgtttcactacttgaaaaaaaatgaaaatagccgtgtcaatacgaatacagcccaaaatatctaaaaacctacaaaaatattagctgattatatctatttttttcttaagtgaatatgaataaaaaattctttgtaatttctatttaaaaaatttagcaattagtagcataacaatatttgttatgctagatatagcaatgggaactattattactgtaataataattattattctgttgctcaccttgagtttttccaataaaaattgactattaatttgaacttcttttttaagagcttgtgccaaattaaatatgtctttttgtaaattcttttctacagaatctatcttagcatctaaattaaatatgtctttttgtaaattcttttctacagaatctatcttagcatctaaattaaatatgtctttttgtaaattcttttctacagaatctatcttagcatctaaattaaatatgtctttttgtaaattcttttctacagaatctatcttagcatctaaattaaatatgtctttttgtaaattcttttctacagaatctatcttagcatctaaattaaatatgtctttttgtaaattcttttctaaaaaagaaatctcagaaataaggttctcgaaccttataccgaattgtttttctaaattttccaaatctctatatgtaagctcattgtgataatatctttttgacaaatcttgagctattaactgttccattcctagtcgcagaaactctctatatatttgatcttcggtaatatttgtcgttgccaaaactgctttcataattcactcacctactatatatatattttaacataaatcaaagccaaatatcggaacatttccttcaaaatctcataaagcagatataatgcacacaaactaaatatattttcatatttaatccctctttatgagaaaaacttattccactttattaggaccgctacccaccttaaatccaatttttctaaaaaaatttattttattcgttgatattttagtaatttatataataataaattgaaattattagataaaaagctaaagctcataatttcaatttatcttgatgattaaaaattcaaaacaaataagcacttaaagatctaagcgctttatatctaataaaatttattcttttgaaactctcaatatcaatgcttggtaaactttttaaacaatcaaaataaccttgcacataatattattggctccagaatcataaacaaaaactactttattcccttcattgccattaacttgagacatacactgaagctttgctttcttttttttaaaaaagtctatctactttaacatctgactcattaatgccttctttgactttttttgttgtaactttttttgatttatccctacattttctgcaagtcttaaaaagatatctacttgctatttcttatctttttgataatcatcttcaaaatttttagctacataattttatttttggctttacttatcaaatcattaacaagattaatatcgcaaaaaaacaaaagaatagggttaaatagatcccactaaaacactttttaaataactctcatcttcctgaattattgaatcacaaacagattattttccaaaagtattactattatttttttcatataactttaaaatctacgtattgatttataaattctctgattatatcagttactaggcttgtaaacaaaaaaggccagcgaagcatcaaatgcttcgcctaaccttctaagctgcttgccttaaagtccttaaatttctgatttaactcctaagaaatgtcacttattttccaagtcttccaatttagtttttacatttaacactatcttaaatgtcccccacaactaatgacaaattgtaattagacatcacaattaaaagtatctctattttttattttattgctaataccctgagaaagcctatctactatttatttaaaccattcaattctccattatttattacaaattgaaaagcacccgttattttttataaaccaatagccatataatttaatgtgatttgtttcatctaatgtcttctagttatagggtttctttctgcatgggggctgcctaagacttgatatgccaccattataacacttgcaaaaaatcaagtaaaattgaccataaccactcttccacaaaagcaaacataagtggtaattataaatctaataaaatgcaagccattttttattattacaaacagcgtaaagtggctcttttaaattttaaaaagtcttttttattaattaccaaagataagtaaacttgcaaataaaactacacgtattgaaagtagatttgaaatttccattatatttatatataatggcactaaatatctgaaaatgaaggagaagcgggtgggcaataaaattttttatatttcagtggttttaattttaatagttggttgcgactggggaactattaaagataaaagtacagaaatttccaagctattaagaacggacaaagataagactaaaaatcaagatagaatagaattgggtgaagataattttgtatctaaaaataatatgtctactactgatacgggcattactagtttaggaagtctaaacaacttggatttaattaatcgttcacagcgggtcagtgaaccacctataatctcaaatgagaaagccatagctactcaagcaaaagtagatttaatgaacaacattaatgttactataataaacccaaaaccagctcaaaatttgggaaattctttaaacaatactactactgaagatagtgtgaagtttttatcaattgaaaaccaagagtggcttattagtaaaaagattttgcccagtaagttggaaaatttagaaagctttctaaaaacacaacacgaaaaagaagcttttaagacggctaaaactatacaaagtctcattagtaattccaatatgggtaaagaaattattaagtttaaggaagaatattacaaactttataatttgtttgaaggcatacaacaaaaattccatagtcaaaggaattcatttataaaagatactaaatttggggaaaatagacaaaaaaatgcagttatatttaaatccttttcatctatagagaaagaaattagagatttgaattataagttgmgtgaaatccaaagtaattttcaaattgcagatgttagctggaataatgcaaactctcttttaaaagaatctatagaaaaattaattcaggcaattgaaaaaaggtatgacaatgagagtagaaagcaaggtcaaattggtggacctgctaatagatgggataaaaatcaagctgacaattttgctaaggatgcaaagtataaggcagaacattcagcaaatgatttggaaaatgcagccaactattttagatatagttgttcaaatgaaaaagaagctaaaaagctattagaagaaattaaaaaaagatttgtacgaattggtattagcctataagtaaatttgaatatttcaattttaagtattatgcataaatattagtaataacctaatattatgcataatattccaatctgagatttctctatatattttttactttcccaacttttatgtatgacccttttgatttcttttttataaaaaatatcttctaagtaaatttaaaagtatcgcgtaaataatattgtgtagaaactatcaaaaccaaaaagtcagaaacaagctttaacacaaaatatcaaaccgccttacccaacggactttatgcacatttcttatcaaataaatctaagtttttcatctttactcttaacactatattctgaataataaatccttgcaaactcaaccaagtatcaatttttgaataaagaatataaaattttggataatggggttttaaagcttattgattttaagaagagaggcaagagcttgcttaagataaatttatcaactttttcagaatataaatactatctataaacacagcctggagagggattaatattaatctaagcaaaataaacacaattaaaaggcgaaaactaatataattgctttaaacttttttgttttaatctttaattatttataagtctgcattcaactatctcatatataaagaactggtaattacttttgcaagaaatcttgtgccttgggtcactttaacaacattagaaatggattttataacatctttttttgccactgcttgatccttatttgatagacttagacttaaaaatcattaataataatattgacccttctttggcccccttaaaccgcttcatctagggcatcttcagaagctattaaagctttttcaacttcttctactttaacaaattctttttttgtcaattctaattccttattatttggagatttatttgacattatttatctctctattaaagatattgccttattctacaacataaacagccttttaagcttgagcggcctttttagaaattttaacaaccctatttaatccttggcaacatcaaaatcttcttccctccgaaaactttgctacaatcgctgcttcttgttatacaacaacagctctcttgataataaatgacatcaaaaacattgaacctacaaactttttaactatattcttgtcagtaaatttaattaactaaagaagtgattctttaacactctccctaatttactaagaacactctctgttaactttttaatagtatctaaatatggattaacccgatatttttaatctacatttaaccatcttttttatctgattgtcctaaaatattagattgaaattgaataatattcacattattaaaatctgcaaacacatttaaattcacaaatccaaacaacaatccactaattattaaacattttagacattgttaattctccttgtttgaactgatttatttttaacaaagattatcaaacttaaatttatattaaatggaaaaaaacagttctattttataatagttgaatttattattataaaaacatatttttatatcaaacaaatcattcaagcttattaaaatttctgcatatcaaaaaccaatgaacgatctctaaattaacagagacaatttttaatagagaaaaactctcgccccacctaaaagacaatagttttacacaagctaactatttaatgctttacctgtcatatttaatctaaaagaaaatactagatcatcaatccatgttataaatgaagccttatgcacaccaaaaatatcacatttgcttgtgttttaaacaaagttttttaataacaataagaagaataataagaatgcgttcaaactgtcaaagttttcaagcttgaaaataaccaaatcttggtttagcaaaaataaaggtgatgaacttcatttggtaggcattactagtgcaagaccaagcaataatatctagagaaaataaagtcgagctcaaaaatcgtgcttttagcttccttatagaggatacttttttgaccaatatacttattctccccttgacaaaaaaatcaaatgtaaaggtgttaaaactttattttggtacttacgtggaaaatactaaaaacaaagaagaaggcacttgggtgataaatgactagaattttgagaatatcataaaaaacttcaagccaataatatcaaattttgatttggtgctgggaatatggaaaaaacaggaaattatgttgacaagctttaagaacctattgttaagaataaagaattatttgctatttacatcgaaagaaacaatgctaataaaaaacattgtcctttaaataagaacaataaaactcccattagctaaaaatagatgattatctcaaaaatttagtgaactggtgtttagaaaacacttgtcctgaattcttgaccaccgaatttactaagaaagaaacacttacaagaagagccctggtaaaagctttttggaataccaaaattttgcattccaaataatagaagtcttcctgataattattttgtaaaaaaatagacatgatattgacaatagcgatcttaattttcaaggtgagtgaatcagcaagattagcctcattcattcactgtaatgttggttggcattgattaacagataccactagatttttgatcaacattattgatcttgatgatcacatgagtaacaaacatttatttatagatttatagtatacagattgcaaagaaaaaaaaagacctaaaaacacctgctgcttatgtttttacagatatgatatttagaagaaaagttgatgacgattttcaaattcaactgaaaaaaactctcttttgacagtcaggttttaaacaattttaacaacaagctttgcttaaactgtttgtcaataaaatatttgaatttttaaacaaaaatacaccaagcaacaagtttacatgtatttagaatgttttttttgcagtctttaaaatgaataaagctggcaacccggcataagacattatgaactactatttctaaaattaaaaattataaaaataaattcttaatttatcctgtgatagccttttagatcctttttcaaattttaaatttactatgttaactataaacacttttgaaaaaggtctttggctttttcctatagtctttttattttattttaaaccactatttctataatctttgacttaaaactgtgattagctaaaaataataaaatatttagttaggtattgaaattaatcaaatattttgaatataattaaagcaattattgataaaaatacactgaacatggagattaaaaatgaaaccagccatatctaatcataaccaccaaaccaataaaaataaactacttggtaaaatctgtagactgaaaaaaattatttcagtaatcaattacttaaataaagaatttaaaaaaaaatataatacctcaattaataaagaacactttacttctaaaaaagtaaaagaacttcgagttcatcatcaaggagatatccttcgcgtactaaactcaaatatacatagagaaaacaaaaaagaaaccacaattaatactctaagactagatttaaaatttttggttaagctaaaagcattagaaaaaagaatactaacattttcaaatagcttcggagaatttaaaggaaagctttgtatatataaagtgtcgcctattgcatataaattgattaatgcatattttaataacactaaaatagacttacttaaaaaagtaaaggaagagaaagaatcttttaagcctaaaaatatcactgaaaatatcactgtatataataaacaatatataaatatatataataagaattctatagaaaactctttctttaaaagaattaaatcaataattttcaatgcaaaagaaccaactaaatcattaaaaaatactttattaaactataaagattttaaaaattatctaaaatatgattatgagacaaaagatattaaagagtttttcttatctaagctaagtctttataaacataaaattcactttatgaggaaaaccgcaccctataaaactgatttttacactcttgcaggagaatttaaagatacttatactactaaatggaaggtaaataaaataactagcttttcaggacatgctaggataatagccaataatattctggttaacactttaaaaaaaggattaaaatttgagtaaattacttgaaaaactaaaacaaaaaaaaactttaatgaaaattgacaatattttaattaaaaaagatatttttagcaaaatagaagaaatagatggaaaaaaagtatactatacgaaaatatttaaacatttaattgattttaaagttactaacaaagaacaaagattaagacttgtattccaagaatttaataataacaataaagattattatttttttaatcttttttcattgggaaaaaatgataaatttttgggaataaaatatggatgggattaccttgaaaaacccttctttcttaaaaaagaagacaataaaatttatgcaataaagaaactctattatatagagtttaggtttaaaaaaggatccgtcaagtcttacatattatctttaagaactttgttgagaaaaaatgaaaaagaaagcactgagtattatcagtttacgctaaatcatctagaaaaaatggaaagtaaagtatacaaattttacaataaaaaatcaccggatggaggaattttaaaaaaatggatattaaaaaatcagatattataacaatggcttcaattaagggaggagtcggaaaaagtgtgctttctatacttttttcttatgtattaaaggaattgggcaaaaaggtgcttctaattgatttagatccacaaaattctttaacttcttattttaatagatatatttcaaatattgaaaaatataatacatatagtatgttaaaaggagatttccattttaatgaatgcattaaaaaaattgatgattatatatctataatcccctctcaccccattttgggaaaatttaattcggaagccattgattacaaagaagttattttagaacatcatttaaatgaaaatatgcaaaactataattttgattatgttttattagatactcctcctagtttagattttcttttaaagaatgccttgaatgttgcggattatattgtgattccagttcaggtagaaatatggtcaatagaaagttttactattttgattaacgcagttaatgatattacaaaatttagaaagaaaatatataatatttctattgtggaaaaccagtttataaaaaatagaaacacgataaaagaagtggaggacttgctttataaagaatatagagaatatattaaaggcaagatccatttttcaaatagtataaaagttcttataaatggacgattagagccctctaaaaaagaaatgtattatagagaaataaaagatactttaaaaaatattttttctttatagttggcatttttactaactataaaggtacttatttagggttgtccgatatcggacagataattttactaaaaattatctaaaaataggagataaaaatgaagaaaaaagacaataaaaagcaggtaactttatataaaagggttgaaatctcaacaggcaaagaattaagtttaggcaataatcaagataaggaattgagaaattacaatgagttaaaagagcagttgaaattaaatttaaaatccgatattaataataaaattcaaagaatgaaaattttatatgaaattaagcaaaaagaactttataagtatgatggcttcaaaagttttaaacagtttatagaatcttatataattgctagaagccaagcttatatgtatttgaaaatttatgagaaagttttagaagggattatttctattgaaaaagttaaagaaatgggttttgtagctacatataaaaatatactaaaaaatagcttgtcagagatatataaagaaaatatggttaaagaaaacccagaagaaggtgttggcacccaaaataaatctattagaattttaatgaaagatgaaaaagtttatgatttttgcaaaaaagatatcaaaagaatctactttattttagagaagctaattaaagataaaaaaaatatcttatcagatcttataattgagtatgaaaattataaaaaagataaaaagataaaagtgagctcttgattaaaattgtataatatattataatcaaactaggttagagagcttttctctctccgtgttcagtagtaaaatatttgcccatagggggctttttttgtgcctactatatattaaaaaaataataaagtattttctacttacaatttctataaaatttaggtagatataaattcaaaacaaaagattgttaaagtattctcacgagattaatcttttattaagcatttatgcttttctcattaaatctgatcaaccttttatcagatttaatttttagggtttagtagaatttttatcaacaataattctttcataaattttattatttttatcaaattttaattcaagtagcctttcaactttaatggcgatctcttatgtcgcagaaaataaaaattttaatgttaataaattgtattttttatattgataaaaatacacagaaacacgtaacagatttacagataaaaaggaaaaataaatcgcgttatttttgatttttgaaatccgaattttagtttttggtcaaaacgggtaatatcatattttatttaaaaataagcttaataaaatctatagaaataaaataagattactttaagcacataataatatctatctttatctcaatagcattgttgagatttaaaaaaccatttatttttgtatttattttaatttttttactcttaatttaataaaatcaaacttcaaattttggatttttacgcaacttttttactatcctaagtttattaagcaaaaaaatattaactttataaagttaatctcaataaatttattctaattagtaaacattttaccaattactctagcatcatttactaatgacttagaattattatggtttacaatatctacgggctatcttctgcaaacaaaattcaggcttacaaataaatactcttcgaaagtaatttcacacttcagcaggctacttaagcttaaaaatacgccctgaaatcaccttaaattcttgttaataatttcatattttgagcaatctttcacaagttctttgatttcgaaagaattgtaattattagatctttaaatttgaaatcaaagaatttttatacgaatgaattgatttgtttacatgaaatcctagatttttaaattttttaagaatattgattgatgctaatttaattatatttgaatttctttttggtttttttggaaaagatgcgttgaccattattaagattttttctttgaaatgaatagtttttgtgcgctgtttgaatagcattaaactcttaaaaaatgtatcaagcagctaaagtcttatatttttattttttgcagttctctttctccgcattcacctatgaaataatataataataaatacaatattatgttaagtatatatttcagcatcatctataaaaataattttaggaaagcttgttttcaatgattcgtcaaatttagttttatagatatttgagcaaggaattatttagatataacgatgcttgaaaatataaaaaagaaaacccaaaatacaaatttataaattttataaataccttatttttaatgtcattaagaatggattgcttttattattcttttgttacttctaaaatatcaacagcagatgttattttaaatagttatatttttgcaccttgtgaaaagcagatgtaaacaagtgtttttctagagtaaattttttatgataagggggtactgctacactatgtgatgttggtgtatgaatttgtgtgaaccgctatttaaaattaaataataagcttttataaagttaagtaataattacagcattaaagatagattattgccttgctataaagaatacataaagcatttatatggtttaatttcaataatgcagtacaccagcaaataaatacaatattaaattgtatttattaaaaatcatattatattgatattagattgatatattcaattttaatatattgtattacataatattataggatataaaataatacaatgtaaaattttaagtaaggagaatatttatgaaatataatacgattataagcatatttgtttgtttgtttttaactgcttgcaatccagattttaacacaaataagaaaagaactctaagtaaggggataatttcaaatcaagatgcagattctgataaaataataaaaaataaattacttgatgatttaataaatttaatagaaaaagcgaatgcagatagagaaaaatatgtaaaaaaaatggaagaagaaccttcggatcaatatggaatgttggctgtttttggaggtatgtattgggcagaatcaccacgggaattaatatctgatacaggtagtgagagatctattaggtatagaaggcgtgtttatagtattttattaaatgctattgaaactaatgaattaaagaaattttcagaaattagaatactgtcaataaaagtactagaaatatttagcctatttaatctatttggaagtactcttgatgatgtggttgttcacttatattccaaaaaagatactctaggtaaactagatatttcaaatttaaaaagacttaaaaatttgtttgaaaaattattatctataaaaacaatcgtttcaaagatgtcaaaacgtcttttattggattatcaaaataatgaaaattttataaaaacagataacgccaagcttggatcttatgtggttgcactttccaatcaaattcaagaaaaatataatgaagcagaaaggctgaaaagcgagataattttaatatataccctttaaagggtatatatatccactttctgagtcaatattggcatcctttctctcggcagcagaactaaatgcttcaccaccaccaacgctctcctaatatcagttagtatcaattggattattatcggcatcatttagcacaccattatcatctttatcagcatccacaataatcacatttaatatctactcactactaaccttggtggcatcatcagtcaagttttgcatttacaatttttatagatttaaataaataaccttattacattttgaattacatggtaacaaaattaaaaaagatcatgaatataaagaaataaaagctaagacaggccccgtatgaggttaaatttatgtattttatttaataaattattttcaacatattttgtattattatttgtaataatagatatactatagtatgttatgaataaaaagtttttataagaggataaataatgaatttgtttaaaattgaagctaattatattgatatccttaataaggaaatttatctagctagtataacgattgcaaatggtcatattgtgagcatgacaaaaattaatgcaatattagatgagtatatattgccaggatttattgatgcacatatacatatagaacgttctttttttattccatcaaactttacgcatttggtagttcaacatagcactgtggcgacaattagcgatcctcatgaaatagtaaatgtttttttccgcatttaaaaaaggcagtaaaggattgaaaaatctaatcaagaaagttatagaaagagtatgaaaggttttttattgttaaattaattaggagctattaattatatgtctaaggaaggtttaaggtttattgctataatggaataaggaattaaggtggttgggggcaactgtcccgaagtaaagcttgtagattatgccccggcagatgtcttccgggtttaaaaaatctaaaaagttttcattagataaagtaagaagttatttctattaatttttgatttagaaatattagtttattaaaatatttagacgcaagcactgcatttctaatttcctcgtcaaaatcacctactattttcttatttgaaagtttttctttaagtaacgcaacaaggtattcccaaattatctctttatggaatactacaagcttcatgttttatatataatgagcagcacttccttttagttcaagttcgttaagcattttcaaatcatactgcacagtgcacatacaagcagcccttttgctatcttttttaaaagtatgagtggcccctcctattctgtaaatatcgcaagcctaataacgcacaatcccacatgttttttgtaattttgatttttagtgctaattgtccaatatatagacttatattattattttattttaaagtttttatttaaggcaggtctctctgttctttaatatagtgaacattaattcatttttttatctaaaaattttaacaatattttgttctatatatttttttttacaaaaacgatttaaaattatcaattacctaacatggcattgactatattaggaatttacaaactaattttttagttgttaatctatattttatttattttttagatatgctgctttgggaagtgtgacaatgtctacgttaattatcctagttccattattgggagtaaattctagtaataaatgaatatgatctttatcgtggctgaattcattaagggctattttctacaaaagcatatattaagcactatttggtttggtaaagaaaaaatgaacgctcactatttatgcatcttaacctataatttcatagaaatggatgggcgataaaatataattaaataatacttaagccccgcaagatcttgaattaaattattatatttatcttttataacacttaaattaccaggttttgtccatatgacatagcctcctcctacaattttcaagcctctccttcttttatttggtttaaaccagattcttcatctcaacaaaataaatattgttattatcttcttaaaggctctcttaatgtagcttaaagcccaaaattcaacttaataatttgaagaaaatatagggttaaaagcttaagtcaatttctgaaggatcaagtgttaattttaagaaaaatagagctggtttccctaaaattagattaaaagaatctttaaaagggttgaaatatattaattaaaatagcataatgatttatgctattttaaccaccattttagttgctttgcaagttaaaaggcggtagtatgtgttgatgtggtttaattacggctatactatataaatgctactactaattttttatataatcttccaatattcttttttatcattttgaatgaagttatttaaatataaatatttataggatttattgttttatcattataagggtatactagtcctaactatgctaataattgtcctacgtgctgattttgttaaggttttcgttgttatgccatacaaacttcatctgaacttgtaaatttaatagcactcactatcttttaatttttctttttttatatttttaagaattcttccagcgtcttttattctagaagaaactcttggttatatttatacagttatttgctcaaatatccatagaactaaattttgcgagttcttaaaaataaattttcctaaaattatttttgtagataatactgaaatatttgaaatgctcaataaattcggaacagaacttattaattctcatttactaaaagttatttcaaattagacaataatattgaaaaacgttttttaaccttggataaagataaaaaacaaaataaaattatagaaaaaattttttacaaagaaaaaacaaatgagctttaccatagcttttgacattttatattacaagagctgcttgaactaaatttttggacttgtttcttttacagaagatcctataatatcttgaaatattctataaattatttacaactttaaagttttagaatctttaagacaataaccataaaaaatctattcataagtatcccatttttacagcaatataccttgaagtgttgaaaagctttaactatcgatttttttaatatcttagcacaaatctatgtactattactaatataagagagtcttcttttaaagaagactctaattttaaatattaatatatttatatattttttttccattttaagacttacttaaagcattttttgcctgttcaacaacttcttttataaagcttcttcttcctattgcctcaccttttttagaagaataattttctaagcaccttaaagcatcctctgctctatttaaagcctttttagataattgtgatgctgccctatttttacttttttccaatcttttaataataccttcttttaagctttccttagcttcatcaaaaaagaaagcggcagatcttatctcttgttctgcagtatcaatgcaacccataattttatcaagttcgtctcctatctttaaattattttgcaattgtactagttcccttattttatttctattattatgagaatttttcattagtgatatttttttattctgaatcttagttatcacatcataaaaatcacttcttattaaagtatattcatgtttaagtgagcacacattctcaattaactcgggaaatccagattctccaataagattctctatatctttaattgctttatccgcttgcttttcttcctcagtagaagggaaaaaatcctcttcttttatctcttttttttgattatgctcaattgaaatggttggtataccaatcctattattagattctcctaaagacaccgcagattctacggagggcgccactacaggttctaaggggagggtggtcacgtctaaacccttgtctttcaatttttccgaatttttaataaaatcttttttttcttttttatttccatataaattattaatagcattttcttgaacgccatttaaagcttcttttatatcattgttatttttttgttcctctttattaccagataatttagaatttagattacaagacatcaatcctatcgttaacaatgtatataaaaacattttttttttcataaaaatactctcctttcccttaatcaagaatatatattacaaataattattcttaattaatactaattattaattaagattatatatcattttgtttgaatttcaataaaatataaataaaattaattatattttatacttttttgcttattaatcatttggagaatatatgataatctctgaactactattttgctttaagaagaaattaataaattgtttaaaactagaaaaattttcatatttataaatttttttgcttaatttcatatagaattcattctttgaattttattattaatattggactaaagcttgataaaaaaataatatcaaatcaaaaattttagatcctatacctgtaatattaagaaatcctttttatgatgtaaaattaaaaaacaataatttgaatatattagatttagctaatgactataaaaaaataaaaaatgaattaataaagaaaaaaagtttaacaatgctgaattttatttatattttaacccattaaactttataaaggatttatcaaaatcaatttttagctttctaatattatttttattaataataattctttaatgaattctcttattttgcccaaattttaattcaaaaagctttccagttttaataataatcttttctggaagcagaagagaaaagttctaatgttaataaattgtattcttttacaaaccctattttaggtagttttatataaccattttctattcttattgagtttttttgattattagttctataagtttgcctatttttcttacttttatacttaggaaatccttgcactctatttccttttttaatttctctaaaaaaattactatacgcaaaatttaagtcgatccacgcgctacaaagagccaaactatcaacttcctttaaaaaaggaaattcttcttwatatttacttggataggtaataagattttgtctattatttttataataatctttcttatcacttaacattttgttatacaaaaatcttacacatccaaatacttttgaaaaatattttttttgattggtgttgggatatattctgcacttataagctttattagcattcattattttttataattataaaatcatattttaacttgcgttacaaattcatctccacctaaatttcatagaaattataggtggagtattctttgttatttttagataaaaatctttcgcatctatattatgtacttcatctttaccctccacattaggcagattatctttatcatatttaattaataactttttttaaaggacagttggaatccgttcattccaatgtcaagattgggttcaaatcccgcaagttcatcaatgattcgattcataagatttttgtagtatcgatcttcaaatagtactggcaaataaattgagattaagtaggatgatccaaacgtgagcattcctgaaagtagtagtatcatcgaagatatactagcaggttcttttttcagatttttcatttgaataactccagttgttaaaagggttaatcctagcaaattaaatccaagcgtgcagccacctccaatataatctccttggacaaaagaccccactccaaaaggtaaaaataaatttaacattactggaatccatagatctatcaattgttctttttcgtattgcaaaagagcctttttagtcttttcggggtctttcaaaattttttctaatttctggttttgaatgaactccttttctctttcagcatatttctgaattttatattttgaagtgaaatttaaagcaaagatttgcatcgttaaactaaaaattaatattaatgtgaaaatttttttcatattaatattacctcctaataattaagttttgatatttaaataatagtgcaatttttagattttatttttggaattgaattttttaagatgttgttgagcatacttagctatgctaagcagattttaatgtagggtttgtagagttttaataaactcttttagatttgaaattatgttgtctatttctttttgtacgtcaattatcaatatctagatttggtttttcttgatttgctattaaggttgactgaatttcttatttcaaagttttggtgtttgttgcaagtagattagtaagttctttagcgcttgtgatctgtttaaagctggagttggtttatgcacaaacacaaagtatatatctaatttgagatttagtaataaatttaaaagataatttatac

SEQ ID NO: 206 - DNA, 36849 bp, Borrelia burgdorferi
aactactaatttatataatcttttcacttaacattttgttatacaaaaatcttaaatatctaaatacttttgaaaaatatttttatttacaatttattgtaattagaacaaattgatatataatatcaattaagaataattattatttataataattattcttaattgataaaaggagaatatttttatgagaaaaagtttgtttttatatgcattattaatgggaggattgatgtcttgtaatctagattccaaattatctagtaacaaagaacaaaaaaataacaataatgtaaaagaagtttcggatagtgttcaagaagatggtcttaatgatttatataataatcaagaaaagcaaaaaagctttactaaaaattttggagaacggaaatatgaggatttaattaatcctatagagcctataataccttcagaatcaccaaagaataaggctaatataccaaatatttcaattgcgcatactgaaaaaaaagagacaaaaaaggagaatttaatcccttctactaatgaagaaaaggaagctgatgcagcaattaaatatttagaagaaaatattcttaaaaactctaaattttctgaattaattagagaagtacgtgtaattaaagatgaatatgctttaataaaagctgatttgtatgatgtaattggaaagattaacaataaaaaaacatcattaatggagaatcctaagaacaatagagataagataaataaattaacacaattgttgcaaaataatttaaagatagatagtgaacttgagcagcttataaatatgattgatatggcagaaaatgaaataagctctgcggctttcttttttgacaacgctcagaaaaggttaaaagaaagcattattaaaagattagagagtaaaaataatagatcttatgcattaaaattgtctagacaggctttaagtgacgcaagaagtgctttaagtaatttagaatcttttgcctctaaaagaattgaaccaatggtgagaaaggaagaaataaaagagcttattaaacatgcaaaaactgttttagaaagtctcaataaaaaataacaaagaatattccacttataatttctatgaaatttaggtggaaataaatttacaaagtaaattaaataatttcagtgtctgtgtgtaccaaactcagactttcacaaacagaggctcatcaaatctatttacgctgcattatgcttatccattcttcttaaataattctcatatccttttattaaagatgaaatataatcttctccttttttgtttttgcaaaccttaaaatcattaagcaaagttacaaaatcttctttggttaacgagtaaagactggccacaatgaaattattttcattttctttttctttaaagaattcatctttggggtctagatttaacatcttgtcaacttcttctttgccaaactcaaaatattctaagtaaagcaaatatttaaagttatcgggatcatttttaactattagcaaggaagtgtttttagctaaagttaagtataaagagttatttaaaatctcatcctcttcgggttgaggcattgggcattgatataaacatgattttagcacatttgagttaacaaatcttctaattataaagtcaaacacaaatgagttaaaaattgatataataaataattttttataaagtgatattggtatttcctcataatttatatatattgaattcacgcaataacaatttttaggagaaagtgtgctaatcatcgttctttcatttgtgttacttgcaattaccctatagaatactctttcggcttgatattggctgtctttcattaatactttttctaagtcttttttatctatccatagtaatttagaactttcttttgcagctctatcttcaaaaaatcttgaattaaattggtgaatattggctccagaatacagaaatataaatttttcattattatattctttatacagtgccttatactttgttaaatttagtccctctctaaaatcaatatactcttgaataagagtatcaaatcgactaaacattttattaacaagcgtgaactcagcgctatctctaaattctattatggactcttgaataggagatagccttttgatttgagctatatccaattcgattcccttataagcattttcattaccctctttcagatcactggttatttctttcatgatattatcgctactctggataacaaattttactctaaatttcgttgtgggttctttactattactgatctgaaatattgcaaatttgaagccaggggtcatggccctaaaccctttctgattttcaaactggtatatataattaagcttgtaatttgaaaatatatgctgcctcagtgctttagagccggattcgctccacaaactggaaggagtcaaataagttaagttgccgccgggcttcactagcttcaaattgaaagccgtaaaatatctaaaaagattcggacccccccactagaaaattctctgaacaccaacctatacatattattcaaagttttcaaactgttcttttcctcatagcgctcgatactcaaaggatgattctctttactaagtagttcttgttttatcttattttgttcttttatgcttagttttctgtagttaagaacatgttttgataaaaattcagattcatcaaacttagttttctcccatggaggatttccaattacaatatcaaatccttcttgaatatctggaaactcaattccatagtgaaaaaatttataataactacttaattttctaatttttttctattttttctttatcttcactagaaattttactgtctaaaatatttccaatcaaattaattacggttgtaatatcactaaattttatattcaaagatttatcaaaagacaacgaataaagtttaattaaagaaaatattattcttaaattatttatattttcattttcctgatattctttgtatatctttttagatttttctaaatcttctttaatggtataattaatacctttgattttttgatggatatcttctaaaatagtcataatttcgttaatcttttttacaactgacaagcagttacctctaaattcgttatccaaaatattcaaaaattcatccttggtataccctaaaagggcatttcctacttttatgtgatgtttaatcaagcttagtggcgtttcaaaaaaataaaggtattaatccataaacctaacattgcgatttgtacagatatatgatcaatatcaactccgtaaatacattttccaagcaacattcttttaagaacggtcttccggcttatactgtcttgaatattatattttttagctttattaataacatttctatactccatatctaatttttttttacatcttcaaatttatctagctcgtaccacactttttctgttaagtaatctagacaagaaattaaaaaatttcccgatccacaagaattatcaatgatttttatatctaaaggggatttagttttaagccgttcttcaattgaagacacaaccataaattccgtcaaatcttctggggtgtaatatgctccatttttctttctgtcaagagatctagatgcaagataaatattgcctttataataggtagcaactttgtttactttcttgtttttaagctcttcttcagaataaataaaataagttccatttttaagaatgcggtgaatagtagtaaaccaatatctatcctagtgtattatggcctataataggcccaataaagaatattttgatctataaaggactatatgtcttttatggatttagaacatgaataattatttaattaccaatattaagctaaatacaaaataaatccaaatatatctttaaattctagaaaatttttaatctaataaaaattattattatagtgccccaaacaaaataaaacttaaattggggaaattagtgttacataaaatgaatttccatagaagatttttttaaattggaatgctttaataacgttatttgacatgcaatattaatgaaacgattgccaatcttctgaaaagaagatgaaaaaaggtttttatatagcatttataacttataaaatggtgtaaaatactcaatgggattgaattgatttaaactaaactaaggaaatttagcaaagataaattaagtaataataaatataaaaattcttatatttattcaaaaatttgaaaaaatgatctaggttttaaaaaaaagacattaaaactagattgactgatagacatactcaaaagattttttgtatctaatcaaataatttaaaataattaagtttatgataaattttagttccaaaatttaatcccaatattcaaatccgcagacattttttagtatgtgttctatggtaactttttgagattttagagaatgatttgaagtgattttgacagtttttaatagaaaggtttcggttctaattataaaatttaaaacggcaactttgtcaatagtcgaggatcccttttaaagattgatttttttgaatatttcgttaagatttttgacaatgaaattgataatcggtctggagcatggcaaatacctttggtctttctaaaaaaataatcatattgaattagaaaattttaataaaagttgagacacgaatctttgagtatgaacccgaacttgtgacataaaaatttttgaaagtcaatttcagatcaattccattcacggtatcgataatatctaataatattgtttttatattttaaaattcattcttttttgcaaaagtttcgacaatatttaaaatgctatttattgaaagctcatcaagaatgaaattcactatgttatctatattttgattttgctttcactgtttagatgcataaggaaaatagtatatatgatggtttgggctcttctaaagttagtgtttgttctatttgtcattaaaaaaaaaaagactctggttttgtttgcaaacaaacttgctaggtttttgatattgtttactataggaggtttttgaaatttttgattattcattatattttaacctcatattatggaataatttgattatattcaatggtttttataaaaaccccaaaattcctttgaaaaaaatttcaagaggattgcgggtgttttttttgaatagaaaattactttgggattttagttgaaatttttagaatttttctttttattagaattgtaaaccaaaatgcccagttttaattattaaagcacaaatgtatggccattgctgcattctctattttattggctgcctcactcaaagctgccaatattttagtatatttgtcgtcttttttatctttgagttcggtgctcacgcccttgaaataggtttccacattggtcataagagtttttatgcactttttggcttcaattttactaccattttctaatggtacctttatcgctgaattttcagcattaaacctatttacaacggttttaagttcattgtatttttgggtacttttatcaccattgctacttaccgatatttttagcaactcatccagtaatttcaccatctttagtccattcttcaaattacttttggctgcataggtagcattataacctatattaattagtgtttgaaaaaccgaatcaattttttctgatgaattcttaatcaatttgattaagcgaggagtatcctttacttctatgtttttactttccttggtatttttttgatcttcaatttcttttttggatttttcagaatcatcttgagcttcctttgctaaattttctagctcttccggagttaattttgtgattttttccgaacttagacctgtagcttcacttatctcatctaatacttgatcaacagatgttagtgctgatttactttctgcagttgcttcatcaatgggattgtctacatgccatttacatgaaattattagcagtatagatattgccaatattagtttactcatttgtaaacacctccttgtagtgtaatatttaatatatttagtgaattatagctcaaaattcatttctaccttaactgcaaaaatctttacaattaacttgtgggtaaagatttttttaattctggtttgggaaattctaattttttcttagaggcattacgccttctttgatttttttataattttttggattcacaagatattttttgagcttttctaagaatttttttatttttttcaaatcttatgtaatttttcttattttgactgtgtttcggtcttgatcagcactcaactattttgatttttaacttttaaatatcttatgaaatttatgaataacaaaattggaaattatcaagttcttaaaagttatttgaagtatacaattcaaaaacaaatggaaattgacgaaataatttcaaatttaagagaatttggcagtccatatatctatgaaagcaatgttggaaaaaatattttttttgttataaagcagttcatgggtttatttttagtaatcgattttggcactatgattgggatattgggaatatacttttcaatatttgccccattttacctcaattttttggatatttttaattaataggcatttatgagatttttttaaattcacaaatagggcgcacatttagtaaatagttgcaagaaccctttgccaaagaaagaaaatatttttctccttttttattttttaatgtgttaaaatcattaagtaagattttaaattcttttatagttaaaaaataagaccggctacaataaaattattttctttttctttaaagaattcgtctttggagttcaaatttagcattttatttatttttgctttactaagcttaaaatgttctaaataaagtaaaattagaaaaattttcaagatcatttttggattatacatttgtaccaattccacaaactgtttctgctgggaataacaagctctcccatttttataagtttttaagcctttatatttggattgctacgaattaatgttgtcaacattatcttttagtagcattaaaatttcattaatttataattttgtatactttttaggattactattatccttttaggatcaatgattttaaatttactgctaggtttactcttcaataagggaatcttcaattctttatcgccgaaaggagattgttaactaaatcaaaaatcttcttatccctgactttcacttttgaggatttttatagtctaagctaaatatttgcactataactacaccgcctaaaggagtttacaaatgagtaaactaatattggcaatatctatactgctaataatttcatgtaaatggtatgtagacaataccattgatgaagcaactgtagaaagtaaatcagcactaacatctattgatcaagtattagatgagataagtgaagccacaggcctaagttcggaaaaaatcacaaaattaactccggaagagctagaaaatttagcaaaggaagctcaagatgactctgaaaaatccaaaaaagaaattgaagatcaaaaaaataccaaggaaagtaaaaacatagaagtaaaggatactcctcgcttaatcaaattgataaagaattcatcagaaaaaattgattcggtttttcaaacactaattaatataggttataatgctacctatgcagccaaaagtaatttgaagaatggactaaagatggtgaaattactggatgagttgctaaaaatatcggtaagtagcaatggtgataaaagtacccaaaaatacaatgaacttaaaaccgttgtaaataagtttaatgctgaaaattcggtaagcgtttcttttaaagaacattcaaacagtaaaattgaaactaaaaaatgtattcaaactcttatgaaaaatgtagaaacatactttgaaggtgtatgcagcgaacttaaaaacaaaaatgatggtgagtacgaaaaaacattgacaactttaagctaagcagccaacaagataaagagtacagcaataaatatatatagctatgcttcaattaggtgtgtagatcgcgtcatggtatgaaaccgcaagctatttatatgggtttttagaaaaaatagttcgccaaatatcaatccaaataataagaaacggttgtaacgattcttaatattttttttggataacgttcttgatcgcccaagcttctatcaattggaagaaattcaaaatatccttgatttgcgtttttaattttccccaattttgaacttgaatgttttgcaaattccaaagccgctaatttcgcatttctaattgaatctgctaacatttcgggctttatatcattaatattgtcaaagtaatatcttggccccccactattactaattaatataccttgattataaagctcagcaatatttttttctgctgcttccattttctcaatattttttgtatgaacagttaaagatatatatgctctatacttataaagagattctttgtaagtctcttcattaaattccataaatcccatttttatatggtcttcgctaaatccatgttttaaaaaaaaacttttaatcttcgataagcttaaattatttgctttattaatatcatttatagtgttaccggttaagctgtatctaagcccccaactagaagacgttgataaaatttctctttcgctaagaccctttaccgtaatataattttcatttttggtgccaatgttttttattccgtgagaaattataattgatgatataaacaaaagtaacgaaaataacaagaaatatatttcttttcctctaaacatagattgacctcctaaaagcaataatatattaaattactgtatttaaatttattttaacatattgcttaatattaataaatccgaatacattttagtagatcataattttatgaccttgctaaagacaatgttttataaaaaagaaaagccaagatagctgcataatttaagttaattgaagcaattaaaagccatcatgatattaaagcaagaagttattttataatcttgtgtttagaaatagcacataattatttaacatttcaaaatattgcaaaaaaatcatttttaaattatatttaattttataatgattactatttaatatttattataagtttgtattatggctttgcagatattctgtaaaaccattttaagggctttatttatgaaaaaaaattaatattattaatcaatatttttttatttatttcatatcaaaacgatggtttaaataaaaataaggctagcaaaaatcataattataaaaaacaacttgggaaaaaatatgtgcggggagaaaagaatgaacttttatcttggataaataattttgtagaagttaataataaagccatagataattcttttgaaaaattcaaaagtgagccatctaatcaatataatcttccatttaaaaatgttagttggtatacactaaggaaaacacttgctgataatgtagaagaatctaaaaaggctagagggtgtttgtatgcggttttagattacaatgaaagcgagttgaaagaattaggattaattttaaattcaaatttacatagcattaagaagattgctaataaaattatgcaaaatgcgggcatagaattccaatttagatttgaggcaataatgaggctgttacttgataaaaaaaacaacctaatgttattaaatattcctgatcttaaaaggattaaaatttgtcttgaaaattttttatctttaagaacaacctttagagagcttgttaaacaattattaaatgattataacagcaataaagagtccatcaagtctgaaaatatcaaattgggagattatttaaataaagctttttcagatattgttttaagcatggataaaaatcctataaatctagaaaaagagattcgaaatattattgttatttaattttaaatttaatgtaaaacctttttataaaaatcaattaaaaattgtttgatactttaccacataatctttgctggtatcaaaattagaattgctagctattttttatttaaattttttctatttattttacccaaaaaattatcttcgatttttatcgtatataacaaatatcgacgatttttattttttctaaatacagttgcaattaaatatactggcactttgcgctataatttaagtttaaagattttaaggtagagtatattatgaacaaaaagtttttaggagaggataaataatggatttatttaaaattgaagctaattatattgacatctttaataaagaaatttatccagctagtatagcgattgcaaacggtcatattgcgagcatagaaaaaattaatgcgacattggatgaatatgtgctgccaggatttattgatgcgcatatacatatagagagttcttttcttgttccatcaaactttgctcatttagtagttgcacacggcactgtggctacaataagcgatcctcatgaaatagccaatgttaatggtattgatggcatcaattttatgataaataattctaaaaaaaccgagtttaaatttttttttggagctccttcttgtgtgccagcgttgtcacaagaatttgaaacttcaggatatgtattaaatgataaagatatagatgaattgatgaaattagatgatatttactatttggctgaagtaatggattttaaaggcgtgattaacaaagatattgaaattataaataaaataaattctgcattaaagcgtaataaggttgttgatgggcatgctcctggtttgtcccccaatttaactttaaagtatgcatcttcaggcattagcactgatcatgaatgtttaacaatagaagatgcaagatataaattatctttgggcatgaaaatactaattagagaaggaagtgccgctaaaaattttgaatctttgcatcctttgattagtgaatgttctaaaaaatattgtgattccttaatgttttgttttgatgatgcacacccaaatgacattctaaatggacatattaatttaatagtagctcgtgcaataaagcatgggcacgacttttttgatgttttgaaaatagcatgcattaatccggttttacactataaaatcccagtggggttgttaagaataggagatcctgctgattttataattacaaaagatatcaaaacattcaaaataaataaaacctacattaatggtaaattggtttttaatgatggaatttcacttatcccattaataaatgaaattcctataaacaattttaattgtagcaaaaaatctatttcggattttaaattttccactaaaaataagatgatcccagtaatcaaatgcatcagcaaccaaattattactcataaaactatgattgatagcaatttattggccccagattttcaatctaatattgccgaggatattttaaaaatagctataataaatcgatataaagacaatagtaaaatttctataggatttataaaaaattttggaataagaaacggcgccataggaagtacagttgctcatgattctcacaacatcatacttgttggaagcaatgatgaatatttgtgtaaagcggcaaatacaatcatccagaataaggggggtttatgtgcactaaacaatgaaaaaactataataatggaacttcctatttctggattaatgagtactctttcagccgaaagagtagcttcacaatatataaaattaaatgatttttgtaaaaatgttttaggctctcggcttgatgatcctctaatgactttgtcttttatgtctttaacggtggttccccatttaaagataaatgataaaggactgtttgatgttgattctttttgttttgtagattattaattttaaattattataaaaaggcaaaaaaagattaaaaaattaagcgataaaattgtagaaggaactcaaaagttttttgtctgttattatctattaaggattattaattgtgtgtctggcagttttttattttaaaaattttatgcattaaatccttaagcaaaaagtagtttttgattgctgtttggaggcacaagcaccataaataatatcctgtaataacgcaaaacgttactattgatttaatttatggaaaccatatgtgtaaatattgatgcatcttctcaataaataacatttataccccccggttaaaataaactattgtttgtccaagtcttaatcttaagaaacaaattaattaattctttagctcccttagaacccgagcttatataaaaactagtgaaattttttttatctcattacatctaaaaataaatcaataaaaaatcatttttgtttcggctccgcttttaatagcatccttatgagattatatttttgcacttatattttttattacctctataaaaattttattttaaaaaaagatatttattaattataatatcaatattattgggaaatagttaataaaaaattaaacatatacttttaaataaagtaaatattaaattaaggagttataaattgaaaaaatatattatcaatttaagtttatgtttattattgctttcatgcaatcttttttcaaaagattctcgatcacgccaaaaatacaattttaaagtacccgctaaatcggtttcaaatcctatcaataaagaaaatatagacactgaaaaaggtactaacactacactttgcataaaagaaaaagatagcagaattataattaaagattgtattaataatcaagagctttttaaagtaaaatctaaaagaagatatgattttaaaaaagccatgcttcttggaattcaaacagctttaaaagttataaatattggcaataataataaaaaattaacttccataaaaaaacataatgatcatattttattagaatttaaagataataagatatatataattcgattatctgaacttaaaaaacatttactaaaaagcaagaaaaaaccactattaggaagtccgataccgggcggcggagatgcagaatttgtagatgatcctgatggcagaatagaagcagaattagaggcagaacaagagcaagagatgttagatagagaagattttggagacgaagaagacgaagaattagaagaagaaatatttggaaaagaaaaacctaacaattgaaactaaaatactacatttcaataaaataaagaagcccctaaaaataggggcttctttattttattgaaatgtaacttgctaaagccactgtaaatctaaagaatatcacttaattttagatttgtatttttaatactacaattgataagcttctaattcaaatatttagaattttttataagtttaaatcaattagttttttgatgctaaaattcaacttcgtacaataaaaataattaatttatggttaattttatatttttaagatcatcaaaaccaattaggtaaaattctttataatttttatttctaaaatccagcaattagcagaatagcgatttacagtatattttttaaagcgctttcagcttccctataataaatttctttcaaagaaggctctaaaaggtcatttataaaaacttttatactatttgaaaagtgaattttaccttttatatatttgccatacttttcataaagcacttcttctacctcttttaaggtattcctatttttaataaattggttttctataatagaaatattatatcttttgtttttaatgatctgaatattatttattgtttctgttaaaatagaaaagctttctattgaccatctttctacttgaactgggattataatatggtctgtaacatttagagcattctttaaaaggaaattcctactaggagaagtatctattataatataatcaaaatcaaaacttttggtgctcttatttaatctaaattctaaaataatttctttataatctatatcatccgtgttaaatttttctaaaataggatgagagggaattatagaaataaattcattaattttattttcacatttatcaaaatacgtatttccttttaaaaattcataaacgttatactttttaatacttgaaatatacttattaaaataagaagttaaagaattttgtggatctaaatcaatcagtagcacttttttccccaattcttttaaaacataagaaaaaagtatagaaagtgaacttttgccgactcctccttttaaacttgcaagtgtaattacaattggttttttttgatccatttatttataacccccccatcttttagttttttattataaaattcatatacttttttttccatttttttcaaatgtgataaattgaattgataatactcggtagtttctttattttttcttaaaagtgttcttaaagattgaacataggctttaatagagccatttttaaagacaaactctatataatagagcttttttattgcataagttttattattttcttttttaagaaaaaagggtctatcaagtttatcatgcttatattttatttctaggaacttatcattttctcttaaaggaaataaattgaagaaaagaaaatcttcattgttattaaattcttgaaaagtaagtcttagcctttttcctttgtttgtaattttaaaactaactaaatgtttaaatatttttgtacagtatatttttctactatctatttcttcaattctattgaatataattcttttttctatatcactttttttgtttctgagtttttcaagcaaattactcaaatttcaatccctttgacaaaattttagataaaatattattggctattgtaccagcatgtcctgaaaagctagttattttatctgctttccatttagtagtataaatatctttaaattctcctgcaagagtataaaaatcggttttatagggtgcaatttttctcataaagtggattttatgcttataaatgtttaatttggacaagaaaaactctttaatatcttttacctcataatcatattttaaataatttttaaaatctttatagtttaataaagtgttttttagtgttttaattgggttttttgtattagaaactatggatttaattttttttaaaaaagagttttctatagaattcttattatatatatttatatattgtttattatatacagtgatattttcagtgatattttgaggtttacaatgctctttcttttcccttaaaacatctttttctttctttacttttttaattaagtctgatttggtgttgctaaaatatgtgtcgatcaatttatatgcaataggggatgccttatatatacagagctttcctctaaattctccgaagttatttgaaaatgttagcattcttttttccaatgcttttagcttaaccaaaaatcttaaatctattcttagagtattaattgtagtttcttttttattctctctatgtatatttgagtttagcactcgaagtatatctccttgatgatgaacccgaatttcttttagtttttcagggtcaaaatgaattctgtgtattgattcattatattttttttcaaactctttatttaagtaaataataaccgaaattatttttttaagtttacagtcttttgaaagtaatttattagatttattggtattaatttgatggctataactaggtataacggctttcattttttgtccctcagcttaatgtgtgttaatttacagttaaaaattatagtatataaaataataaatttcaatcttctgttaaaattaaagccaaaaaccattttaagaatatttaagctaattgggagagggggtgattttttgacaaaaaagcatttactattatgcagtagctagaatgaagctttttaataggctcaattaagaatagaataataaataacaaccagggtgtaaataatcaaaacaatctaaaaaaatagattttctttaaccactatttatataatctttgatttagaaatatcctcttgtattgttcagaaccgaacgattttatttgtgaataattattgacacaaattttaacttgtgtcaataattattcatatattagtgatattagatttattatgtgtttttgtctcatgttattagtctaaacttattttttaaatgcaagttaatgttaaatacatataaatatctgcttttaaagcaataggagtgcaaaatgatagggaaagaaagtaaaaagaaaaataaaaaagagatcattttaaatgatagatttgaagattttattgataaaagtcaaaatttaaataataatcaagatgaaaatttaataatttataatgatctaaaagaccaattaaagcttaatttaaaagatgatattgacaataaaattcaaagaatgaaaattctatatgaaattaaacaaaaaaagctttacaaatatgatggttttaaaagctttgaacaatttataaaatcttttataattgcaaaaacccaggcttatacatatttaaaagtttatgaaaaggttttagaaggtgttatttctattgataaaattaaggaagcggggtttaatagcatatatcacgccatacaaaaacaagggttatcagaaataaatcaagaagatattaatacaaacaacaaagaaaatatcccaattagaattttaataaaagataatgaattatatgatttttgtagaaaagataccaaaagagtatattttgttttaaaggagatttttaaaaataaaaaagatattttatcggagattataattaaatatgataattctaaaaagaaaaggaataaataaattttcaagggttattgactttaatgcttaattaatgatactctattacttctaataggcttaagttgttttgcctagtttaatgtcgaaaagatgccccgaaaagggtttttttcatttttaaatctaaattttggaatttgacattgaatgctaggttttttaactttaaatccctgttgcatgtccgagtaattaataagctctctatcactatgtttttataattatctacaaagtaaagaaataataatttatgtaaaaaatcttttctttgatttgaaattttcttatatagcctagcctcttaatttagatttgtttatattaatagaacctttttgttttttgataattttctttggtatttattaagcctattttcattttttgttacatatttaggatgatttgttttttcactttcactacttgctaaaaaattgtaaatcaaagtctttgatttattttttaattttgggaggggattattatgaataaaaaccgggttattacttgcgttgtttttgcactgataagttcttttaaaaatttttcacagctttgttgcttatatagttctgagcaagatgcttttaaagaagaaattaacaaaagactctataattgtaattttaaaaatgaaaaggataaaaacatttttttgtttatgcttcacaaattggagagcgtttaagaaaagttcggattaaagaaaaaagtgttttttagatactctttaatcaagaggtgtcttataaaaaaataataaatctaattaattgagaattgataaaaagtgagaaataagtttaaaagcttattctaaatataaattatttatagtcaagtaaatattaaaataagttttggtcgacttgctctaagattagtttttttaattaaaaaaaactaatcttagagaagagtattgtgagtatcaagaagggctaaaaaggatttgtaaataacatgatggtttaaacataaacaatgaaagccgattacattataaaaacaaatgatccaaatgtatctctttataaagaactgtaaagagactttataagaaaagaaagtattaatagtttaaaagacttttttatttttataaaaaataaactttcttcaatagatgataattcaacagaagcaaatatagagtctttactaaaatctattttcgaagaactaaattattcagtagaacaacaaaaaggtgggcaaatagaaggagtaaaatccaaagtagatatactactttttgaaaatgataaagacaaagtagattttaataaaaaattagaagaagctaaaaaaataattcccatattttcaactgaagatatcttacttatagcggaagttaagcatccagtatttagttttgatgctaaagataaggtaaaagaagcagaagatcagctatatagatgtctaaatcaatatcaaaaacattatggaatactttcaaatggaaaggtatggagcttatatgataaatctaagactttatggagaaaaaagatatattgaatttgatttttctaaaattgaagacaaaaaagaatacaaataacaagaatggtttattttatttagctatattataagaaaagaaagctacctaaaaacaagtaatgtaatagcagttgaaaaagagcaaatagttaaagaaaaagatataattcaaaaaactcttagagagatgctttatgagaagcctgatgactctatagtatttaaaattgtaaaaaaaatatatatgacaaagaatttaaagtatcagacaaagaatttactcgttatattttggctagcatacttaaagaggcaattatttttattttaagaatattttttattgcatatatttaagacaacgacagttttaagaaaattttagaagaaaacaagctatacagatcttctatatcttttagatatttttttatgattaaaatacaaaaaagaaattaggatataaaaaataataacaatttttaatttacttgataagggaagtgattcaataaagttccccgtatttaatggaggattatttgtagaagataaggttaaatatttgaataatgaaagtttgctaagtattagtgaacttgaagaaatacttgttaaaatactcttctttgaagaaaaaaatattaaagatgaaaaatttgtagagtattcaaggttagatcccaaaagttttggagaattatacgaaacgctacttgaatatggcctaagaattgcagatactactgttcatcgtattatttaagacgggatttatctcattcgtaccgaagaagagcttgcaaacaagaaagtaaacaaagttgctacttacatacaaagaatatgaggaaagtgaatatatagataatttaagaataatattttctttaattaaactttatttattatcttttgacaaatctttaaacatagagaactagactcactccaaagagcctaaggaaccaaataagttaaattaccccctggttttattagtttcaaattaaatgcaacaaagtatctaaaaagatttggatccccaccactagcaaagtctttaaaatcacttttataaatatttattaatagcgcttatactgcttttttcttcattgtattcagtattcaaataataattgtctttactaagtatttcttgctttattttattttgttcttttatgcttagtcttctgtagctaggaatatgttttgagaagaattctgattcattaaacttagttttctcccatggtggatttctaattacaatatcaaatccttcctgaacatctggaaactcaattccatagtggaaaaattttatagtagctacttaattttctaattttcttcattttttctttatccccactagaaggcttattccccaaaatattttcaattaaactgattatatctgcaatatcactaaattctagttcattaagaaagcatatatttgctaattataaacttaactatatttatcaatttcaaaatcaaaaaagatttaaagatgtggtagcactttttaaatttgcaatatttcaacttagtaatactaaaacctgcacatcaagttttaaagcaaaatttatgattcagggcaatgataattgataaagaatataaaggtctgattacagttcgaattctaagaatgaaatcagcatatgataagatggtagctacatttaaacttttttcaattttatttagaagttattttttaagatctgtttataaaatttaataaaaagtactttgttcaccctcttgatagcacttattttaaatttttaaaaagaaagagaaattcaatgaattgataaataatagtaaatattagtttagtattattacaattaaaattgtaataattttgcctctttttgataagaaaagtttattaatttttggaatccgacttaaaatgatttaaagttagtattaactttaaaggagagaaagcatgaaaaaagttaaaagtaaatatttggctttgggattactttttggttttataagttgtgatttattcataagatatgaaatgaaagaggaatcccctggcttatttgataagggaaactctattttagagactagcgaggaatctattaaaaagcctatgaataagaaaggtaaaggtaagattgctagaaagaaaggcaaaagcaaggtttctagaaaagaaccgtatattcatagtttaaaaagggactctgctaataaaagcaattttttacaaaaaaatgtaattttagaggaagaaagtttaaaaactgaattattaaaagagcaatctgagactagaaaagaaaaaatacaaaaacaacaagatgaatataaagggatgactcaaggaagtttaaattcccttagcggtgaaagtggtgaattggaggagcctattgaaagtaatgaaattgatcttactatagattctgatttaaggccaaagagttccttacaaggcattgcaggatcaaactctatttcatacactgatgaaatagaggaagaggattatgatcagtattatttagatgaatatgatgaagaggatgaagaggaaataagattaagcaatcgatatcaatcttatctagaaggtgttaaatataatgtagattcagcaattcaaacaattactaagatatataatacttatacattattttcaacaaagctaacccaaatgtattctacacgccttgacaactttgctaaagccaaagctaaagaagaagctgcaaagtttacaaaagaagaccttgaaaaaaatttcaagaccttattaaattatattcaagtaagtgtaaagactgcagcaaattttgtatacataaatgacacgcatgcaaaaaggaaattagagaacattgaagcagaaataaaaactttaattgcaaagatcaaagaacaatctaatttatacgaagcatataaagcaatagtaacgtcaatcttattaatgagggattctcttaaagaagtgcaaggtatcattgacaagaatggcgtttggtactaatattaatttttttaatttaaaacaggctacataatatgtaaatatgtagcttgtttaaagtaaaataattaaagttctagttgtaaaaaagtattgtggataagaaaatggatttcgtcaatttacaaaaggtatattaactgatttagataaaagtcaaaaatattgttttgatttatatcagaattggtagattgccatgttttaaagtaagtatttagaatagcttttactattaagcttgcatacaaaatggtattgtcagcttgattccaatcttaatttcattttatcaactcaaattaagattggaatcaaatgaaacaaaaaaagtgaataagaattcatcaaaagaaattcgcaaatatgttaaaggattacttaatattgttaaaaatattgtgcctgttacaactaaaaggttaaagaactatatttaaaattgtgcagggtatctaatgaagaataatggccccttgatactttggatatcattactatactatttaataagagaaaaatttatttatcactcaatattaagcttgttttttcccctatttaatattttactatccaatttaaatttacttgatatttacttatataaaacaattgaattttggattttatatgcggagcgactaaagcttgtaaagcttatgaaagtattaatttaaaactaggttagaaaagcaatcttagatttagtaatgaaaaactcgatacattaacttttttcgtaaatgtataaaatcagcgcattttaatttttattgaaaaggagatgtatcccaaatagaagagtatgttaaaaggtttttattcaaactgaaaaatatgggtaaagttaaaaagccgcttagctatattaaatatggtagagataatcagcttaatgtagaaggtaaagatagaaatcatatagatgtgaaggagcatcatagagataaagggggatttgctaatgtttttgataattattttatgttttcaaatcccccatctctttaagtggatagcaataatggagaattgagtgcattagactttctcctattaatagcaatcctgtgaagataagacgttgaatgacatttaaaatgtatgccagagatttagagattcacattaatgaatattactactttttagtgttgctattatttgactatactttagagaaaagtatttgattattattaaatacaagagcttaattacactatttgaaaattgcgagcataatatgtgtttttttattttagcacaagttttttagactttctaaaaaagttaaaaaaaaagaagatgctgagtaatttgtatagttcttttaagattttcatttaagtaataaattatattatcttggtatacttctaatatttacccattaataaagctagtttggcttaacaaataaaaaccaataaatatttaaaaaatgattaatttagaatataatttctatagctaaagcaaaaaataaatataaatttggactagttttattacataaaaagataaaattagtcatgcttgttgcaatagagcctactatctatcccgcgaggtatatttatttatattgctttttagtttttgtaaagtgacttttaattattaaaatctaaggagaagagatttataaacaaaaaattttctatttcattattatctacaatattagccttcttgttagtattaggttgtgatttgtcaagcaataatgctgaaaacatgttgtatctaatatccttgctttcttttaaagcttctgctaaagcatcatcagccttgttatttgtatctctaaaaataacacaagctttttctaaagaataagttgcatcaacatagcaaacattaagagaagcataactactcttaaccttgctaatggctttatgcaagttatacaataaggaatacttaactttattagatctaggagtagttctagcttcttttaaataagaggcagctgtgctaagcaagcattccatattactaaggcttacttttatttcatctagttctgtatctagtctaataaactcttctacataagagtcgacttccctcttaatatctctagcttcgctcccttggttattaacttgctgaggagtagggctactattattattttgtatgttagtttgcatgtctttaatcatatctttgcatactgcctgcatcttgctctatctgtattcttgccccttaacaccttatcattaaagaatatatcacatttgtaaaaatagcttgtattatttgatacaagctataaggctaagagaaaagtaaataagtaagtgggcttggttaaaaaagagaataaggactagacttacttaagtaaccaagtaagtttttaattttaaggagaggagttttaatatgaggatatatttgtgtttatgtagtgttcttttagcgacctcttgtaagttattttattcaaatgtaggaactgggccagcagaagcataaaagactagtaaggccgaacctgcttttgatcttgctgttgttaaagaaaagggtgtaggtaagtagtctaaataagagagtaaggcattaggcaaagatgggcttgaaaagatggcacaagaggtaaaggatgtagctagtgatactaaggttaaggtactagatagcatgacaaaaggcggtagtagcaaaataccaataagtgaagtaccttctcttgtaagccaaattaaagaaacagctagaaggatagaggcaggtgtatctgcattaatatcttcaggataaatgtagcaggagcacttaaagataatcttaagacagggataagtagcatatgcttactataaaaatattagaaatggcaaaagaaagtggccttaagcatgaagatgatgattatggtttgcgtgataaggtaaataaggtaatagaagaatttagaagaggaaaagaaggtggtcttgtagcattttctcttaaagtagaaggcgctaagaaaaacggtgaagttgttaaggagtgtgtaactgggttaatgggaaaagtagaaagcctttttggcgatattaaaggaaatggcgatggtgttgctcaagagttgatgcaagaaggtaagagtgaagaaaaacggtttagtaagccattaagcttaataagagaagttgtgtgtgatataacagaagcatgcaagcgacttatttatgacctgtagaatgaatagtagcagttcttaactgctattctttattgttattttttaaagccaagcttctctattctataaaaatagaagccagaagcttagtctagattatcctataatctagttttaggggttcttatgtctagtttgctatgagctatcagagaactagtaaagtataattttgtaattaggaaatatagaaatttatcaataaatattgatcttgtagttagaagcagacaagtgaagtaatgataatgaatcttgttaagacaagcaatactaatactaaaagatgacttagaaagaactttgattttgtcactagctttgacaacctatcttattagctaaaatgtgtgttactattaatagtagatattaaggatgttaaatatagataacaaaagtagttaaattgcagtaaaggagggttatatgagtaattttgcatgtgaagctaaacccaaatatgagtatgtaaagcaggtatttcttgataaggattttccagaagatgtagttgattatgtgctacttcgtagttcaaattatgtatatgaaaacctagaaagtagcatgagtatgctagaaaaggaaatgaataaagctagagatgagtttagaagtggaatagggaagttagatgaaagaataggcaagttagatgaaaaggtagaaaaagtaagaagtgagctttctgcagagataaagacagtaagaagtgagcttaagggtgagatagtaaagttagatgaaagaatagaaaaagtaagaagtgagcttaagggtgagatagtaaagttagatgaaagaataggcaagttagatgaaaaaataaatacaaatcataaagagcttatagggttgtttaaggaaataagaagtgagaacaactcgcatataaaaagcttgatatatccattttattggatattaggaatatttattccatcagtagtgggaatgtttttatatttactgcaaaaatagtaattagtgtaagtgtacttatccattttagcattaatttattcttaacagtattattatgatcaagaatggtctaagaggcaagataatttttaaaaaagcctaagatacaagtacttaggcttttttaaaataagaagatattgttgtgctagttatattgatttggcatccttttctaagtcattaagtatagtagcaaggctacctttactatcatcattcatataaattaatgttttgtgtattagtttaatgataagataagcttgagctaccttctctttagtaatcccatcaatagtaacgctagaaagattgctaccaagatggcctttagccttaccacataaagtctttagcttatctttgatgttctttaagtttataaatttagcatcaaactcttgttctgtctgataacccaatttcttacgctgatcaatcttatcttttgcttctataagactactaagctttgtaatctcataaataacatctttaagagattggtttagtgtgtctttagtagaattattgttgtcttcataattttcaatacctttttcaagatcttttaatttatgggaaatgctataagcctcaagcccagccatcttaacaagattagttaagtcagaagtagtttgcatgaatttttgaagtcttgctttcttttctatttctcctctcttcctcatattgtgctttaatcttatcaagctcttgttgtttctgtctttgctgctcttctagaatagcttttcttttcttctttaattttttcctttatagcttcaagagtttctttaataagagcatctttttttgagtctaagtttgtagcactttttgtatgttcttgtgttgaataagcagggtttgtgagttctttttcttgtgaagaattgtctaggcttcttttttctatgtttttttatctatttcttgtttttgtgaaacacctgggttcaattgttgtaattgagcttgcttattaaagctatcgtcttgttttatgtgtgtttgattagataatttgatttctaatttgtcttctaattgcttttttaaagcttccaaagaagtaattttatcatcaatatttggaatatcttctgaagaaatctgattaatttcatacaatttttcttttaaaagattttctattgcaatctcttgtggtagtgcagtagcaacatctttgctactaaaggcagtattgccagtagttgaattttctaataaaggagcataattgctagaatcataaactaaagtgtctgaattaaaaaaatcattagattttagtgaagagagcttatcacttaaatctttagatattgagcaactaagtataagagatattagatatatatattggtaaaaataagtttgttaagctttataagcatctcctataagtatacttttttaaagtaatatgttaatttttaagattcaatttttgttatagtaacaatatagtgcgtaactagaaagaaacatttaattttaaaaattaatgattaagcaggacgggacgtatagaagtggaagagtaaatctaggataaatgaattactttaccagggagcttaaaatatttatcttagaaataatggagttgttttatatgtgcaaaaaagccagactatttttgttaaaatccaaaagcttccttatttataagtaagtgtcatgtcttctttgaagctacaccagctaagattctctactacttaaagcagcttcatgtgctttatttaactcttcaaactctttatttgcttgatccatcttgtctttaagtttttcttgtttctgcttagcagtcttaaggctaactttagccctgcccattgcttctttagcatcattcatataatagtggtatcgagcatattggtaaccttgagtattgctattatttaacgcttcttgtaaagcatcttctgcttttctatttgcatactcaaaatcgtgcttagaactttttaaggcacttactgcatctgaataattagagttagcataagcatggctgctactaactttgcgaatagcttgatcaagtttaggcaataaggttgggttagctttattagattttctagcattatttaaaaaagaactagcattgtcaactttactttttatattattaagtcttgactttattgtttctaaatctgtagttattttattaacttcttctaaagaggtataaatttcttgtataatgtttctagcttcactagtttccctagagttattattaacttgttgaggttgtctattagtatgtttttcactagcatcgctagcaacggaagggtttgtgtttacaataccatctttttgtatacctaaattattgttttttttactttcttttgcttcttttaggttcttttcattattttgttcttgattatttacttccttataactaatacttctagctttacgaccacttcttttgttgtcttttataagagatttatctacagcttcatatagcttgcaagagataaagcttaaaaataaactgaatattaatactttaatcattaaattcattgtgctaactttatgcaaaaatagagtattattgtaatacaatatcattatattacatttattattagtaatcaagaatatgagttatatgttaagcttatagcatagagcttttttctttaaagctgagctatctaagattagtattatttaataagcagcttcatatgctttatttagctcttcaaagtctgcatttgcctgatacatattagaattaagatattcttgtttatgcttagcgttatctagcatccttttagccctctccattgcatctttagcgtcatttataaaagaatgataatgaccgttataccattcataattttcctttgaagcattttatgcctcaactgcctttctctttgcatctttaaaggcagtatcagctattcccagggaattaaatgcatcattataacaaatgataaaagaagtatgactactcttaaccttagcaatagcttggtgcaggctaagcaataaggtttgattatcttgattagatttaggtgcttttctagcgttctctaaataagaattagctgtattaagcaagctttctatattatcaagtatttgttttatagtttctaaatcttttcttagtctagcgcactcttctgtagaagattcaatttccttcataatattactatcttcattagctttactggattcactattaacttgttggggaagactgctgctactattatcattttgcatatctgcaacaactaaatgatttttgtctatgttttgtttcatataagcattatttgtacttctaggcctgcgacttctactctcattgctgcttcctaaagtattaaaagacttgttgttgtctagtatgtctgtaacctgctcagcgttgtctgcaagattatcatataggttacaagagaggatatttggaattgaaactaaagtggataaaataaataatttagcaattaaattcatctatcttagtacctcttcttagaatctgatgatatttatgctttattcttaaaaaataaatatatcacatttataaaaatagaaaaatagtgaatgctaaatgcaaaccaaactataaatttgaaagaagtagagtagtgcttgtaaaggcaagagggaagtgaaatagttaatttaggtaagccgatatataagcttttctagtaaagatgggattatatatgagtagagatattaaagaaactaaagcctacactggaagttttaaagcttgaatatattttctatttcttttttgcaagaatttccctgttgaagataatcaatagctttttgtgtatattcaatgcatgcagaagcaaagtctatagctctgtatgctaaattttttgcatgttgcatatcacgtccgttaaaactgccaccgaaccggtatgaattgccattgtatagtcttttataaatagattctgctagtttatccttagcctcatctagcatgcctttagcagatacccaagaattagttgcttgctccataaaagaacgcatttcttgtaatttaggcataatagtctttatttttctattcaaaggagatgcgtctaaattagagaataacaagtttgataaagtttcataatctttttcaaactcaaggagtgtattgtttaatttgttttcaggattagcatgattaacaatttgcgtggcatttttaatttctgaaagagatgtttgctcatactcttcttgtgcaaattcatctaagttagctttaatttcttcttctgaaggaatagcaggagttttacttgttgtagtaaggctatttttaaaattactttgttcaattggatcatgttgtggagtagctgatttattttcttccatctttacattattttgagcatgcgagtcattttgtattattgctggacttgaatttggtagggattctttattattagcaccaggatcatctgacatatgttgattagaacctacttgtaagattggatcataagtttttttatttgatgatgtaacgtctttaggagattcaatttccttactatttttatctactgaagtattagtagtatttttattttcttgatgatcttttaatgctaatgcaaactgttctatagattttttagatagaaaaccagaacaactttcaaataaaaaaagagaactaaatactaaattaggtataataaaaatttttattaaacataatcgcataatatttatatttcctttttaataaaactttgttatgtacttatatagcaaataatatctatattaataataattataatataaaaataaagatattaaaggtaattcatgtaattatttaaaaaataatgactttttaagtcaaactataaagttaagagaaaataaagtgttgtttagaaaaagagtattataaacaaagaagccaaacctcataaagtattgtctggcttgtctttaatattttacttttacttatctagagtccatatcttgcaattttttatatatatcatttaactcttgaaagtctttatttgtcttagtcatattttcattaagttctttttgcttattcttagcaacctctagcaaacttttagtactactcattgaagctttagcatcagccataaattggtggtagccagcatagtagtagctctcatgccttgaagcattgctattacttaatgcctcttctaaagcccgatctgcttttctttgtgcatactcaaaatcgttcttagctctttttaaagcagcaatagcatcattgcaatgagtatcagcagaagcatgattactcttaaccttagcaatagcttcttctaggctaggcaataaggctaagttagctttactagatcccacacctcttctagtctgctctaaataagatttagctgtactaagtaagctttttatcttatcaaggcttgcttttacttttgctaaatcttcatttattctattgtactcttctttagaagattcaatttccgtcataatgtttctagcttcactagcttcattatcttggatattaacttgtagagtatggttgctgctactattatcattttgcatatcgggttgcatgtctgccatcaaaggttttttgcctgtatcttggtccatataagtattatctacacttctaggcttacgaccacttctcttgctgtcatcgttactctttagagtattaaaagacccattattgctttttagtttgtctataacctgatcggcgttgtatgtaatcttcttgtataatttacaagagataacactggaaaataaaatagttagaataaataatttattaattaaattcaccttattacttctctttagaatctgatattcttatattaaaaaatatattgcatttataatttataaaatgattaataatgcataagccaaactataaatctgaaagaattaaagtagtgtttgtaaaggcaagataggagtgagatagttaatttaggtaagctgatataagtttttctagtaaatagagtttcatatatgattagagatattaaaaaaactaaagcctacactggaagttttaaagctttaatatattttctatttcttttctgcaagaatttccatattgaagaaaactaatagcattttccatatatttaatgcattcagtagcaagatctatagctctttttgctaaatcttgtatattgcgtttgttaaaattactgcctaaccagtatgaattgccattttcattgtttaatcttttataaatagaatctgctagtttatctcgagccacatctagcatatctttagcagacccccaagaattagttgcttgctccataaaagaacgcatttcttctaattttacccatagtgtggctttgacagactttatttttctatttaaaggagatgtgcttagattagaaaataataaatctgacattttttgatgaaattctttaaactcaaggagtgtattgtttaagttattttcagaattagcacgattaataaactgctctgcatttttaatttctgaaagagatgtttgctcatactcttcttgtgcaaattcatctaatttagctttaatttcttcttctgaaggaatagcaggagttttacttgttgtagtaaggctatttttaaaattactttgttcaattggatcatgttgtggagtagctgatttattttcttccatctttacattattttgagcatgcgagtcattttgcattattgctggacttgaatttggtagggattctttattatttgcaccaggatcatctgacatatgttgattagaacctacttgtaagattggatcataagtttttttatttgatgatgtaacgtctttaggagattcaatttccttactatttttatctactgaagtattagtagtatttttattttcttgatgatcttttaatgctaatgcaaactgttctatagattttttagatagaaaaccagaacaactttcaaataaaaaaagagaactaaatactaaattaggtataataaaaatttttattaaacataatcgcataatatttatatttcctttttaataaaactttgttatgtacttatatggcaaataatatctatattaataataattataatataaaaataaagatattaaagttaattcatgtaatattttaaaaaataatgattttttaagtcaaactataaagttaagagaaaataaagtgttgtttagaaaaagaatattataaataaagaagctaaacctcataaagtattgtctggcttcttatctttaatattttacttttacttatctagagtccatatcttgcaattttttatatatatcatttaactcttgaaagtccttatttgtcttagtcatattttcattaagttctttttgtttattcttagcaacctctagcaaacttttagcactctccattgcatcattagcattatttatccggtaatggtaaagataattgtaccccctaaaatgaggtatatcttttaaagcttcttctaaagcatcatttgcttttctttttgcatgctcaaaatcattcttagcttttgctaaagcagcaattgcatcagtatagcaaacattaagagaggcataactactaatagccttttcaattgctttatcaaggttaggcaatatttctagtatagaaccattagttctagaattttttctagcattatttaaataagatttagcgctatcagctaatctttttatcttatcaagttttgatcttgtttcctttaaagctgcatttactttctcagcttcttctaaagaggtagaagctttttgtataattttactagcttctctagcttcactagagtccttattaagtagttgaggttgtctgctagtatcatgtttcttgttttctacttcactagcatcggaatgagctgtgtctaaaacactatcatctgcttgtatacctgaactattgtttttttcactttcttttactttactttcattattttgttgttgatcatttctgttttgattactttcttttaccccaatttcttcagcatcatctaaagctctagatgtgcgaccacttctgttgttgtcttttatagaatctagagaactattatctagtttagaagtagaatttgtacttttattatcagctatatctttatcatagacaaaagctttagctaaagcttgttgcgatttatttgtaagcttttcatataatttacaagagataaagctagaaaataaactggatatcaacatcactttaattattaaattcattatattacctctatctaaaatagaatattattagaatattttatcattatatcacatatatagtagcaatcaagattatgagctagatgttaagatagatatcataaaactaaataacatagaataagaatttaaataaaaattagaatgagatgaatttgaggataaataaatttattttgattttaaatagtattttagagttatgtattgctgaatctatatcaaaaatatttattcttgaaaaataggttctttatagtttaactgctattactagtttagtaatagtttctttaactaaaggttcttgcacaaaaggcctaaaaagctatcatgggaagatacaagaagccatttctataatctttgtttagaaatagcagttcactatcaatacttttaaatcgacaagttgagataccgaatatgtcacacaactttatcaattttgaattgtatttatttacattaattgataaatttttgtctttgcttttcttattcaatttttatcattcatcagtaaaaagttttaatttttcttttgataaatttgaatacttattaattaataatttaatggtatcgttaaatagctttagatttaatataatttcgtaggttttatatttatcggtttctttatcttttatagtaagatatgcaggcatatagttacagttattttttttataaaataacttaaaataatctgctaaagaattgtcaaaaactccaaaattatatgaataaatgtaattaggttcttttgaagtttcttttaaattaattttggctaaaccagttctattttgttcaaaatcaatattagattcttcagaatttagttttaaactatttatttcgtattttttttcaaactctttagttgattcaaatgctattatcttaactataggtgcttttttgccgagtattttatagttattgtcattaatgctataattataactaaaaaaagttttgaatcgaatgggtgaaaaaatataagagtacctaagttctctaagatcttcaattaaattgttatttttatcttttaaaacccttaagtcaccagattttgcccatgtaacataaccacctgcaagtaattcaagcacgtccccctcttttatttcatttaattcgggttctttaaaagaaagacaagtattttcattacgctcttcaatgggctttttatcatattttataatatttccctcttcaattatcttaaaatccaaaacctcggttttgatactgttgatttttgaagattttggtggagtcaaaaaacacgaataaaataatggtatatataaaaatatattcaaaatatatatgttctttttcataaaatttttccattaattgtatttctttctatttctctatttacatttggatttttatatgttggagttttaatcgatcttgttagaataacaacaaacaagtttaaatgtaattaaaaggattctttagtaaattttttattagtcttgttaaaattattttttaattttttaagcacattttgtgtgaactgctatttctataatctttgatttagaaatagcagttcactagataataataaagctaaaattaatattttagtatttaataattcttgagaaaaggtaaaattggtatatgtttacttgttatagaaaaatctatcttggtaggactttaaatgtttaataaaatagtgcttagataaacttgtatatttacaacagattatttttgtagtaaggtaggtaaggagcatatatgaggattttggttggcgtttgtataatagcagcattggctttattgggttgttatttgcctgataatcaggaacaagctgttcaaactttttttgagaattcggaaagtagtgatatgggttccgatgagattgttactgaaggcatattttctagtttaaaattatatgcgtctgaacatcgtttattggttgagataaaaaagactttaattagtttaaaagatcctaattatcgtgatgtagtacgcccagtgagtgactataatgaggagtattttaataaattctttctagatttagggtctgagcaatctaaagacctgattaagttgtttattatggtaaaaaatgagcagaacaataataaatttatgcgtatagttcgttggctgtattcatgtatagaggagttatattctctagatattaagtattctggcgaggggagccatgagtataatcgtaatatgcctagacccactgcttatgaacaatatttaaaagtgaagaggtatgattataatagcccagtttctattttacctacataaaatctgtgaactcctaaataaccaaaaagtaagcatagtaaaaatactataagtttattgtagttttcggtttgtttatttctgaccccgcaagaaatacaaatctcagcatcttttttaaatcttgccacaagaatagcaatatacttcgtcaacagtttttgacatagttttacactcctttttaaaataaaacatcctcaattaaaagtatttaaatactcaggtaaactaaactacttttacttattttttataaaaatcgatatttgttaatataattatttgtattatattttagtataaaaaatttcaagtgcaacaattgtagttgaacagctttagttttttattaaaatgtgcatcctttttgaaatattgggttattgtacttaatgttttatttgtcgtttgataatataaactg

SEQ ID NO: 207 - DNA, 30885 bp, Borrelia burgdorferi
attttattgacaaaaatattagtttttgctatcatacatctaatttaataaagagaagtaaaaaggtgtgtgatttaagaaaaacaaaactaatagataaaataagttcactagaactatacaaatactcaatattttttagaaattacattgaaaatgtagcagaagattgtctcaagaacggacttattcttgagagtgctgcccacaatgttagtgaggttgaacttgctaggttaaaggtacagcttaagaatgctctgcttaattgtattataagctaccgttttcatgggattggctatgttttagtaaaaaccaaagataccctaatagatctcgaacaacccgttaatatagaattacctattggttttgaataccttgattatgaatatgtaagagatttgggagttgattttgatcatataacctataaagtaaaatccaacaataagaacaattctttagacgcagttaaaatacataaaagtcgacttatcatatatgaaaactttgattatatcttaaaaagatatgttccgtgttataccgaaagctttttactagatatttatttatttgaaaagatatacgtagaaatagaaagacgtattgaaaaccacaatttcttgttttataaagatgaatctttagtacaactacaagacgcactctctagtgcaacaacttctttaagtgcacttactcagagcaataatgataggggaagtggcattttatcttcttttttgagaaaacaaaattcaaacaatcatagtaaagatatttctaatttaagaaaccttaatgactcattatcacaggagcttgctaggctaaaaagcaatctaaataatgagggaatgttttatacggccacccctagtgctagtttagaggttattaaatacgatcttagctacttaaaggaggctttagcattaattaaggcaaaaattggtgcagatactaaagagcccttaaccagaagttttaatgagcaggctaaaggactaggaaatgatggtaaaggtgataggagtaattattacgattttctcaaaggtgtacaagaacaagttgagaactcttgtaatttaaaacttacaaagtattttgggcttgatatgaagtttaattctctgattatgttaagtgaagaacaaaaagtggaaagagatataaagctaattgagctttacagtaaatataaccagcttatacaaagtagctcatttaataatgaggagctagcgatgttaaaagagaaattattctcattttgagaaaaggagttaaaagatgactgagaaagaagaaaaagaagacctgcaggcacaagataaagaagagcagcaaattaaggctgatactaaagttatcagtgtgcaggaatttgaagagtacatgcgttttaaagagcaggcaaatagtaaatccaaagagacaagtcgagatttaagtataaatgaacgaataacaaaagaacttgcagaagttgaagagcgggagcgtattgaaaagcaattgttactagaggctgagcgaattaatgaaattgatacacttgcaaaagcacatcttagcaatcattttaacaaagaggtgctacttgcaaaaggatatacattaaaagacattatgcaagcacaacgtagagaacttgtacgcaagttcgttccaattgagcaaattaaagctattgccaaagtatcagacataagtcatatcgatggagagatattagagcaacttgtttctttagcaaaagtgaatattaaattaagaaaaaatgcgagtagcagttcttcttctgttgactctattaaggggaatattgctattaaatcagaagaaagagcaagtttgcttgattctaattttgtacctattaatttcacagaatttgtacaagcgataagtaatacatacaagcaaagacgaattcaattttatgaaaatctaaaaagacataaaagaacaagtattgcctaaaggagtttttaaatgagtgatataacaaaaattaaacaagaatttgataagaaagttgcagaaattcaagcattaatgaaaaatccccaacaagactcaggattgcttagcaattctattgattttagagaccaaaatctaattttttccaattctggtggggtttgcactagcagtaaagacaaaatagagaattaccctgctaaagggtatccgtataaacggggtgttaagcttagttttggagatggaacaaccgaactagaagttgaggctggtggtggagacgatttatatggagtgtgttccgatatagatgagtttagcggtatggcaactgttataccaattacaaataactttactgggtatttaacgctaaagaaagatggacaaaatggtgtaaatccaggagataaattaaattttaaccaacatggggaacttgaaaaggtcactggggctcaaaaatctgttaatgcaatagcactttcaaaggcacacaaattaactgaagatttatttatagtgcttgctagtgtatttgggaatagagcaataaaagggtaataaattatggctttaaaaggcaacatgcaagtagaaaatcttgaggctgttgaggacccacaggtagatttaggggcacaagtttccgctgctcctagagctaaacggcaagcaagacaagctgaggacgtacaaggggaagatccctatttggagtcaattagcgagcttgatgatgttcttttaaaatttaaaaaatattcaaaatcaatgagttcaattgaaaataaggtttttagcagttcaagtggctgttttaaatccaagaatgagcgagttgatgcatattcatttgcatgttcaagttatacagacaaaatagaggaatacctttacgatccagcgaatagttttccatacaaacgcggcgttaaacttgttccaaaagagaactctatatatgttgaagttggagctgatactgatatgtatgggatatgtgtagatgtatgtgagtttagttgtactgcatatgtattgccaattactaacaattttgaagggtatcttgttacaaggaatccaagtataaaaataggagaaatactagacataaataataacggtgttattatcaaggccggaggtgggccaccaaccgcaattaacatatatgctctatctgattcatttacaatcaattttgcacccgaagatggaaatcaagatcaaaatagatatcctaggcaagagtattctattaatttgataaaagttgcaatttttggaaatagaggccttgagaaaacagtaaatcctgatggtggttaaactttgggcgaataaaaggaggtaaataaatgggagatacaacgcaattagtaaaagagtatcaagagaaaagaagtaaactggaaaagtttatgaaaaatccccaacatgacgctagtttgcttagcaattctaatgaatttagagacaaaaatgtagaattttttgcttctggaggcactagaactagtaagtttgacaaattggaaaatcatccatttttggggtatccgtacaagcgtggagtaaaaagagttattcaagaggctcaagataatcaaagtcactatgagccacatgttgaggctggtggaggtgaagacttatatggaatatgcattgacatagatgagtttagtaaaacagctactattgtgccaattaccaataattttgagggctatttagtggcaaaagattctacggttaaagtaaaagataaacttatttttaataaagacggtgctcttgaaaaggtgactggagcaccaaataaagcaactattaatgcaacagcattgactgatgcaaaacaaattagcaatgaggtttatttagtaaaagtagctgtatttggaaataaagctatgagtagaaattaataatatttgggaggatttaatatggaattatttgatgaaaattattatgcaaaagctgtggcaaatatcataggagaagttaaagatcctattatgtataaatggttttcgcccgatcaaattgaagatgttgatctacaaatgggatatcaaaaaaccgtaaaatgggacgcgtttttaaatgctaatcctacaacaattgccaatgaggttaatactatctcaactattggatttagttctgaagtggtaagacttaattatttgaaattacagtataaattcagacatttaaagcagacttctgagaaattttatacttcagattcatatattggggacattaataataatttacttccttttgctcaagcgtataagcttgcaagtagtgaaattattaaacttattaatcactttgtattaaccgggactgtttcgattcaaaaagatgggaaaaatcaaaaacgcctgcttccaaatatgtatgggctgcttaatatgcccgagcagataaaagaagaggttgctagtggtgataaagataaaatggataaaatctttgaaaagattgaggctggactttcaaagttagaactgggcgacgaattttccaccccgatgatggtaatagttgacccagcaacgtcacttaaactagtaaaaccatacgcagcagcacagggtgcagcaagtagttgtgaaaaatgggaagatgttttaattcaaactattaaggctattaataatagagaagatgtttacattgaaacttcaaacttgctgaaacataaaatactcatttatccactaaattctgaacttattaaatttaaacctagcaagtatatgctacctacaccgaatgaacaagttgataaagactcaaccgatgtagctcattcatacattgattttgttttaggcggtctacttgctactagaaaaactattttgcaagttaacataaagcaaagttaaaagtataaggtaagtgaaaatgagtgaacaagaaagcttacaagcacaagttgcaggagaagaagaacttttagtaacaaaactccattcagaagtgttattgctattaggaatagacaaatttgcactaagcaggcaaaattttctacttcatttatccttacttcaagctattctagtaacacgcggtattgatgccagttcactgacgtatgaacaaatatttttacttactttctaccatatgggctgccaattaagaaaacagggagttgttcgagaatttgaatttgataggatcaaaaaagagaaattcaatgaacttgaacttgattattatcctagtagcagtggaggcgaagaaggcggcgaggggagttgtggctcaaacaagaatttttgttcacaacttgatgcatttttagaaaaactaaaaagagaaacttcaacgccatcttgtgtgggggttgtctaatgaatggtgttaggaaaagactttctgatatgtcatttcgcatgatcaacgtatttaaggatcctaaacccttaaagttttataaaggtactgttgtaaagcttgaaaatgattcttcttatcagagagtatttgataaaactaagtacattgaatttgcaggagttattattgacataaagccacaagaacttgcaattctttatgattctgatatgtctgatattcaaggatattccaaactttacacatatcaagaccttaactatgaaccaaaagaccgaatatcaattgcagatttagtttactttgaaatatttagtattgactcttcaataggatattttactttggttttaaaggaatttatatggacaaactagaatttaaaatggaattggaaattgggtggtttggtggtcgtgcaggtattgctaaaatgcatgaaaaagggagtagcaatttaccagcaagaaaacatttaaccaaaattgctagtagttctgagtttagagaatatatcaataatagctatataaattctaagtttaatcttgaccctaaatcgggaatggaggctattggacaagcttttataagatactatgaaaattatctactatcagcacaagtcactccagccttaaaggctaatacaatcaaaagtaagtttaaaaggggtagtaacactgcagcaattccacttgttgatacagccaaaatgttatcagagattacttataaggtaacacttgaatgattttcactttagatatggtattaaatcatttaacccaaatatttaaagggtttaaggcatatgcaactgaaaataattttgagtgcgatatcataaatacctacaatcatccatatctttcaaaaatcacagctgctagctcaaatataatagcattgaaatttgatggtacagaaaatctatttgatcataattatagagccggtgtattttatgaaaatgctttggaatttagtataaattttcaaatatatattattgcaatagtgttaaacgccaaagactttgacgctaattcacgcatgttaatgctttatagtatgcttagtgactttctacacaataaagctcataagtataatttgcccagtctacaacccgactatattaataaaattaacttctacatttacccaacatctaatatgcaaacagttggactgattaatttaggcacaaaatatagcaaccatgcatacagtgcatctatagcatttaatgctagtgtaaaagcaattgaaattttaaaggaggaatacgaaattgccgcaagatacaattagtgtaagtttgcttgactctagaattcaagctagtaggcctaattattataatccacttttggtttacaaaacagctaaaatcaaagttaataaagatgctgctagctataaaatattgaatttaaccgttaataattatgaaaaacaaattgaaactttagaaaaagagaatggaaatggagaagatcagtttggaaaagaaaaaacactgcttaaaactgcaatgtcaaattttttcaattcaagcgaagaatcgttaaaatcagccgatcttttcatttataaggataagcctgaagagctaaaaaattatcttaaagtacatagacacacttttgttgtacttattaacactgagggagatgcgtcagatgatggacttaaaatttacaaagatgactataataaattcaaaaagccttcaactttttttgtattctcgactaaagaacaagaaataaaagaactatttaaagataaaggcaatactgaaaaagaaagaaatattgctgtttacagcaacaataaagacaatttacaccttaaatttataagtcaatatctccatcaagctagtattttccatgctgtaaatccttatggcatgccgctggctgctacaccacttgttgatgatactgtaattggaaagttgcgaactgcaaaaatcaacttttattcacttcttaatgaaactgggcttgatggtgtacctgcctttaaagaaggtgttgacctagctggaggtgcaatagacgaacaatttacataccactatataaaaaacgaagcgattattgagcttattagaatttggaacaaaaacaataggcaaaatagcaaattatctgcactacaacttagtggagctagagacaatgcatatacttcagcaattgaatgtttactgaaaaggtttgtggatagaggactgataatagagtataaaaatttaaggcttactctttctcctacgccacaacttaaattagaacttagcgtgaatattacttataactttagcattaatgctgttgctttagtaattactactcaagatatagttgattatcaaaacagcttaagtgcttaaaaggggggctaaaaatgcaattttatgatttaagagaagtttatttttcaattggtggtacgcagttacatagtggcaagctagagcttacaagcgaacctacaacaagagcagtgattagtagtgaagataaaggtatgcctgtaataagcttaagagatcccaaaacaataacttatgttttcaacattgaagtgacactaggtagtcatgactacattttgttaactgaactttctgatgaacagttttacaacatggatgtgagaaaagaggataaaatgcttgatttagcattcaatgatagaattgctaccaaaattatttctaactatgcaatttttactgaagagccttcaagaagttattctgctgaggccgaaaaagtatcttttgaaattagggctattaattgccaaaaatctaaaccaaacaactcttaaaaggagattcttattatgataatgagatataaaatgaaaattttaactaaaaataaaacttatgaatatccgctgagagtacttcccgtctatgaatgggataaagtgctaggatttaatcaaagtgacgctgttttaaagcttaatgaggttaaatacttaagagaaatcacaagcttaatgataagtccaaaatttttagacgaattctatgtgattttggatcaaaatagagaatttatttcttattataaggactatcttgttgcaataatttacactgcacaatttaatacttttcatttagacaatgatctaaaaaagcccgctttagtatatttgagtgagtatgaaaataatgttggtgattttgttgcttttgactatattaatgaaaattttgattatgaaaaagtagccacttcactttcatcaagtacatcaaattccaatgagctggttgctaaatgaacaaaagaaatagagatattgataaagctattgcaagtcttgatgagactagaaaaaaatattttaacttgcttgacgagattaagaacgataaatactattttccagtaattatgaatatttgctcatacgactcggttaaaaaattgccttatgacgagcttttagaagtcaatagacttgctgagattaaattagaaaaagaattgtatgaattaattttaagcaagtgaggacttagtgagcgacaaattcaccattaaatttaaaggtattcttgatcatgctgcaacaaaaaaggccattgaacaagatatttctaaaatggaaaaatatcttaaacctaaaaaatctagtttgggtagcactaaagatattgtaaaaaataatttgtcggacaagaaaaaagaacttagtagacaatctaaatttgaaagcttaagagagcgtgttgagaaatatagacttacacaaactaaaaaacttataaaacagggcatggggtttgagaaagctagaaaagaggctttcagaagatctttaatgtctgatagagacaaaaggcgtcttgagtataaagaacttgcaaaagaatcaaaagcaaaaagtaaaatgttagcggcctctcaaggaaaaggacttgttgccaaaattgctataggtagtgccctagggaatatcattagcaacgctatgagtaaagttggaggaggccttttaggttttgctaaaaaagcggttgaagaagacaccaaaacaaaaagaacacaacttctcaataaagcgttttatggtgatccaaaagagaaagagggtcttttaaagattattggcggaatgaagggatttgagcgcgacctagaaaaagaagaattcttaaatcaagcaagtgtctttaagggtactttaagggatttagatatgttaaatgaaactaatttgaaaaacgcagtagaatttgcagctatgcttaaatccagtggtgctatgagcagcgaagatgcagtaaaggctgttaatagtgttcttgggggtgatggaagtgagctttttgatctattaaagaagtcaggtgttggagacaaatatatagaagatgccaaaatggcctggcaaagcggggcacaagtagatctagagtctagaattaccaagatgatggaaatgttcgaggattttaaatctttcggccttacaaaaaaagtcaataatgctgagagtattcaaagtaatttggcctcagctgagcaaactcttcaaaacttaaccactactgtcttggacccattacttgacctcattaataagataactaattactttaaagactttgcgtttgaaacacacattattaatcccataattaatggcattaaaagtatttttaatcttaattatttctttgcaaaattaaaatcgatgctacctggatggatgggcggagatgagggtgcggctctaaaaaaactacaagaagaaattcaaaatcaagacaatgctaacagcacaccataatttttacaaaaggtaattacttatgacaagtaacaaaaaaattgctaacaatgcagctaacaaaatagatattaataataaaattactaacaatcatgatattgaaaagaaaaaaatcaaggaaaaaattaatgatattgaaaagaaagaaatcagggagattactcgaataataagagatgtaataacccaaatatttgcccttttcggagcagataattttttagtgttatttcctagaatggatctaaaaggttttggatatattcctcaattgttttttataaaaccaaaaaatgaactcataacacgcacttataatactagttgttctaaaagaccagttatcaattattatgatagaaaagcggaatatgtaagctacaatccggtaatgactggtgaacatatatcattaaacgggggaatactaacatccttatataaggatatgatttctttactcaaaatgactgtttttggcaatactatgctacgctttgacgctcatcttgtaaaagaacaactagccaatagaatacaagcacaagtcccttttagtatatatagtccaacttttggccttaaagaattagctgtaattacaagtctttcgtttaaagatactcctttcattgacgaagttgaggttagtttatcaatagaaatagtaaaaacatttgcattggaaaaatataaaggataaaaaatgctgttactacaatatgattttaaaattgagttctacaatgtagatacatcaaaaaaatcacctgatggaattcctttcgccgaagaaattcctaaaattatcatcaatacacaagatggaattcatattgatatttccatatccaacgtgtattcaaatattcatactataagttccaaacaagcaaaagtcgtactttggaatcttcccttagacttcaccgacgacattaaatttggagatatagtaaaaatatattataagaaatttgctcatgaaaaaaattttgatttcataatggcaggaactttaggacctcctatgagcactgattatccgggtggggattttagtgtagatcttgatgttcgtttattaactaaaagcaatttcttcaatcgcgaattggcaggcaaagaaggcaaaaactttaaaggcaaaacggtgaaggaggcaatagaatctgtatttcccaatcgcaatatccttaatatggatgaaaaagattgtcttaaaattattgacaaagatatttatgccacaacaccaaaagagtttattgacaaaattaaaggaacatatgttcataacgtaatagccgatattggtactggtttacggggatatgaatgctatctgatatttactaattatataaaaaagggggaaaatgtccactacgaggcattagaagactatgggcttgaatttataccacaacaagaaattactttgggcacaacactcaaaaaaaatcttatattttggaacgcaaaaacatttttcacacataagttaaatgttggagataaagtctcatttattgatggactagggaaaatgataaaaaccactataaaagaaacaagtgcaaggcttagcaatacaggagagtgttcattaatattaaagttagaagatgattctaatacaaaacgtaaaaaataaaggggactagaattagaatgaatgaagactatgaaatttacagaatgaatcaacgcctttatggccaggcattggctcaagaagaccttaaaaattggatttattcaaacatttttataattaaaattggcactgtaaaggagtttaaacatcaaactcaagaagctattgttacaatacccgaatttgaagatttagaaattcacacaaaaaatatctctaatatcagtttagaactatcaaaaggtgattgcgttttactacttcaatcaagcattaatatttttgataaaaataacgatattcactttgacaaacatcatttttatatacttagtgcaattagcccaaagactttaaatctaatctctgatactgttaaaattagagcgaataataaaattgaaatagcaaaccaaacaactagcttaaaaaaaattctagataatattgttagtgctatcaatggtataaaaattataggggactcagtaattgacgaatcaagcttaaaaatagcaaccgctcaaattaattctgatattaatagtttgtttaagtaatttttgctaaatatggtataattactagtatggatttaagattaggcaataattttgaattggtatttaataacgatttatcacttgttgatggaattgatgaacaaaaacaaagatttttgatatttttaaaaaccttaaggggtagtttaagctatgctcctcattggggattggactatttcttgcttttaaagctgttaaaaattaacaatcttcacgctgtaaaaaattattttcatgaaatatctaaagagcttaacttagatttaataaatatttcaactactatacaagacaacaaagcacatatatccttttttttctccggcgatgttttgaatatggagtttaatttatgagcatagtttttgattctgattttggcattttaaaacgtacaattaaggatattgtaagatcgaaaagagaatatttgcgtgtaaattatgggattaatattgatgataatcaaagctcaatttataacattattgcgtcttctttagcattaattgaagaagaaataattgatgagcttaatctctttttttctaaaatgaaaccaggtggtacttattgggctgctattgaagaacacatttcttctaaaagcacaacttacagtgcggttcgcacggctttacttaatcttgatgggattgagtacactaatattaaaagtgcagctggtaaagccaacatatatctaattctaaaggaaactttactagacactagtaaatctaatattaatagtcctgaatttaaagcaaaactttgggaaacattatatctaacaactcctagtggtactttacttgagggagacatagaaattgatggtctcaattcaactggacaacgtaaatcctataaaatatcactagggaaaagaaaatatgtttacatgaaagtaaagtataaacttgaccttaaaaactatctctacttaaacatagactctcaaattagggacatttattctaggattatttcaaataactattctgatatgggaattagctttgaatatcaagacttttttgctccagttaatgaagttaaaggaattaagtttatggaaataagtgcttgtattaaagatacagacactgagagtattacaaaaattggtgatagcgattttaaaaaaaatcaagatattgccattaatgatgacacaatgctacttttcaatatgacagatagattgcttattgatattggatagttaacaaatatgaaaatacccaatcttttcaaaaacaccgaaattcataaatttatacgtacagaaacagaatatgcacaagcattgcttaatgaacttaagtcccttaattccaacttcatatccattaatgtaatagaaaatataaaatcaagatatattgcaatatggatatctcaagttttatctatcttttatgcaaaaactcaaactttacaaagtattacaagcaatattaatagtgttatttttgctttacgtcatattggcactgacgagtcatttagactgattttcaagacctttttaaatgtggacattgaagttactactcctgaagctggggttattgatatctctttaaaaggggtaataaaaacaaactttactacatttatttcgcctagcactaagaaaggaaaacgactaaaaaagataattcttagagaaaagaagccgggatatgctgcatctaaaaaggctttagtattcaactcacttcctaagggctatgatcattcaatttatgcttttattaagagaattattcctattggtagagttctcaaaattaataatacagatggtaacaatattataacttttaacaactaaggaggttttatggctgatgatcaagaaaaattactaattgatgaagaagaaacggttcaaataaaagatttaaataaggttacgaccgttaacgatactgatcttttactgcttgatgatggagctgcaagcagtaatgctatcacctttaaaaactttttagatgcttctaaagacaaaatatttaaaggagagggattagactattttaagcagataattaagtctacaattgccgaagaacttgcagctgataaagattttgtagaaaaaatttatgctaaaataacggacaaattaattaacaacgattctactaatatttctaacctttttagtaaaattaaatcacgccttacagatagcatatcatcagccactttatctagaagtgatcatcttttgataatgccttcatcagatactattcaaaaaacacccgttcctaaacatatacttggagtaccatcaaatcttgcttatggcagcataactagaagtactacactttatccttctgactatgagaataacgcgatatttattaatatggaagacaatgatgatgtaactcttattttttctaaaagttacgataattctcccgtttatcttgatattgaaattcaagtaaaaatcaatgataataggatgcagaaaaaatcattaaaacttcagtattctgatgaaactacatacaatagggtttatgaaattgcgggcccccgcggactattcaccagaattcccatttataaaggatggtatgtccaaaaaagagcctccttgtatggagatccagtcccagatcttttaaaactgtaaactttttagcaaaaattatgattttggtatataatatacgtataaaaataaaaaattaaaatgaaggattaaaaaatggatactattaaattaaccgaacttcttatcaatttaaacgaaattaaacttatagcggtaatgatttttgtaacagtgctggttttaggagtattaattcttctcaagcctttactaaaagacatattgactattgtaataggcaagatttttaagaatggtaatggtaatggcaaaaatcacattaaaaaaagagattaacttatgaaattatccaaagataatgttgagcttggacttacgtctttatcaacccttattgatatattttctaaatttgaagatgaatttgatgaaattgcacataaaggattctttttggtttatgagctgtattctcattataaattaatctatacagcaaatatggaaagacttgagagtgcattaaccccagcaataaatgcggcactcgctccattaaatgaaaaaatcaatcaatgcattgacttagttaattctgatgaaaaaaatctcaaaatatctaatgatctgaaattcaatcaggaaggaaaacctatctataaggaaagaacaaataatgcaaaataacactattggtttaggacttaatttactatccagcttaactaacatagctaaaactgatacaaacatagatcataattacattaatacttttagtaaagtaatagattttttctacaaaacatatataagcacactaaaatctatggaaacagctgagtcaactaaaatatttgaagaaatacaagacattttaaaatacaacattgagataatagaggctatctctactgacaaaagcaaaagaattatcacttcacttaaagcaacacgtaacaaaatcatgaaagaatatatcaaaatacttaaaagaggtgaaaatgcttaaaagattgcattgtctgctaattgttttgttactatgttgcaccactattgccaacctaccagaagagccaaaaccgccaattattccaacactaaaatctttagctaaatatgaaacacaactttcagagtatgttatgtacctagtaacatttttagctaaaacaaaagtcaaagttaatgacccaaattatccagaatatccttatccagatttatcaacactaaaagacgaacactccataactgctgtaaaacataatatcaacatatatttagagtacattaaaaaaacaaaaccaatagcggaaaaagtctataataaatattcccagttaaaaatgtaaattacaaaaaggtttttcttgcaagaaattctactttacatataaaaatctctaaagccaattaatctaaaatagtgtataatatgactataagggaaaattttatggaaacagtgtcaacaaatattgcaagtgtaactcaagaacaaatatataaagaatttattagactgggcatggaacaactaatagcacaagatttatctaaaagatattatcacaatgagctaacatatagagatttagaaaatttagaaaaacaatttgatataaaatttgataatcttgtttctaaaatagatggtgtcaaaaatgaacttaacactaaaattgataatgtagaaaaaaatttacaaaaagatatatctaatttagatatcaagatagataatgtagaaaagaatttgcaaaaagacatatctaatttagatactaagattgatagtgttaaaaccgaacttaatactaagattgatactgtagaaaagaatttaaatgccaaaatagatagtgttgaaaagaatttaaatgccaaaatagacaatgttgaaaagaatttaatgtctctttcagaaatgcttaaatgggtattgggaattatgggagcaatgtctataacaatgatagcagggctaatatttgcttttatttccaaatagctaccacctcacttaaaacatatcaattcaaataataattgtttatccaatatttagtattaatacttagttaagtgaatattaataataaaaaaaggagtaacaatgaaaatcatcaacatattattttgtttatttttactaatgctaaacggctgtaattctaatgataatgacactttaaaaaacaatgcccaacaaacaaaaagccggagaaaacgtgatttaacccaaaaagaagtaacacaagaaaaacctaaatctaaagaagaactacttagagaaaagctaaatgatgatcaaaaaacacaacttgactggttaaaaaccgctttaactgatgctggagaatttgataaatttttagaaaacaatgaagataaaataaaatctgcacttgatcatataaaaagtgaacttgataaatgcaatggaaaagaaaatggggatgttcagaaaaatacatttaaacaagtagttcagggagctcttaaagggggaatagatggctttggtgcaagcaatgcaactactacatgcaacggttcctaatagctattagccccctatttgggggctttaatcttgctatgctgcaaatatctcatcaaaccgttcgtattcttttaagatactaaagaatattaatggactagggccataaataggcctcttaagccccataaacctttcaaaatcttgtaaatcctttaatctattatttttcttgaaatagttttttataatctcggcccaatagtttatgcttttaaaatcactatttttctcaaaatacgagattaaatcagattcaattttcttgatatcatcaaaattattggggtctatattctgaataaagcttattttttgaataattgagtttatattatcttttgttgtagggctatttacccagtcttttatattagacaaagcttctttaaaaacaccgtaataataaagcctatcttttttttgttcttgcttaatatctcttttctggttttgaatagtgttatttttttgaatttgattaatctcttgtttttgttctcttttttgttcttgcttttgattaacactaacttgcttgctagacatagaattttcgttttcgtggttattgtaaataggagctgcatcagtatctatttcactttctataccaagagctgcaactaaagcataccttttgacataagtaatgcctgaaccaaacatctgatacactgtatttgtaactttagacccattttcattgttccattgtaaattttctgtaggaattcgcgtatcaaaagaaaattcatatccagtacttgtactgtagaatgtagtcctaatataatcaactatgccatattgaccctctatagaaattggatattgctcaatatcaagctccaaattgtgctttttaataacatttttaatttctctaactatttcattgaaattttgatatttatatccatatcctttaagacttttgtcaatccctggtaaattcatttttagggttttcatatcttttctgaagcttatttttgcttgaatattattttgtatttcttgattattgtttgaaagattttccatctttttcctccttgtttgtattaataaatataagtatatagcaaaaactatttttgccaacttttttacaaaaatttttacaaaaaaaatagggcttagctaaattctctattatctactaaagaaattagttaagcccgtgctaaaaatttttttgcaaattcaaacaaggtagttaaaactgaaaaatgttcaaataactacgctgtttgtagtgtagcccaattttaaattaaaatcaatttatattttcactgaattaaaaatttctatattaatttaacaaaattaataattaaaatttaatatttttttagaaaagtatttacttttaaatcaaaattttgcattataatagtaattattaataattcaaacaaggagaaaatatgaaaggttttctaaataatgcgaaaagtccaacttgctacaacaaacaccaacacaaattaatatctcttacttcaacactagattatctaaacaaaaaagacaagaaatacacgcaacaaaacatactctattactttaatgaaaatttaaaaagaaatgggctagctcccactacactaagaacaatgcaaaattatctttacaaattagaaaaagtattaaaagtcacaactaattactaccaacacttaggtgtaaattgtggaactgaaatttactataagctaaagtatcctaaaaaagaatgttaccagaaaatcaacaagtactttaaagaacgaaaaaactctagatttaaatctagagttaataaacatttaaaagacaatgtttctaaaaatggtagtgtaaattcagtggagtgtttaagtaataaaaataatataaaagaagaaagaaagattaaagaaatagaaaaatatcaactaagaaattatttcaataattgtaactttaaaacggaagaagctctttctattttgtatttaaatattgataaagatactaagattgaggcaataaatatcttaaaacaaaatgaaattgccctaataaaaaaattcaatataaaaaaatcttgcatgaaagaaaaacaaaaaaaattaaaagaaattctatacaacactaggaaaaaattagaagaaaacgggtacaatcctaaacaattagaaataaatttacaaaaagtatacgaaaattacaaatataagccccattttattattgaaaatcataaatatagcgatttaaacaatataaagcgtaaattagaaaagtcgattaaaagaaaaaaagaaaattctcaacaaaattatcaaaatttaaaggaaaatattttcaatatccttattgaacaactaaaaaaagaaacaaatattgaaattctaaagcctattgtaaaagaatatttgaataaccaaaagaaaatagaatacaataaagtatttggtacatatcatcttgaattatcagaaataataaaaaatgaaaaaaattctttaaccacagaagaatttagcataaaggccgtataaggatttaacatggaaactgcaccagaacctattgaaactgtaaaaaaaggtaaatgtaaagttgaatgccaaaataaagaacgctttattttgattgaaaaagaaaatggtaaagcaatgtaccatacaaaaataatgatggatatttacaaatttggagtttatgagaaaaaacatgaatttagactatcattgagggccttatttaatggagaaagaattgttgaagaaactcatttgtacccaattaaagaaggagataagtttattggtattttttatggctacagaaaaccaataaaaaagccattaataaagtatcaaataaacggggctagaaaagcatatgcattagcaagggcatattatatggaatttagatttaaagccggaagtgttttttgctattttaaagggctatatcgattattagataaaaaaagaacaaataatcattacaacaaagttttatttagtatgtttacggatttagaacaacaagtatataaattttatgggaaaaaatacccggaacaaggaccgttaataaaatggatactaaaaaacctaaaataataacaatagcgtcaatcaagggcggtgttgggaaaagtacgagttcaataatatttgcgacattattagctcaaaaatataaagtattattaatagacctagatactcaagcatctactaccagttatttttgtaaaaaacttgaaaatcaaaaaattgatcttgtcaataaaaacatatacagagtattaaaagatacattagatgtaaataatgcaattgtaaatattaaagagaatttagatttaataccaagttacataactttgcataaattttcaaatgaatttataccccatcaagagttgagattaaaagatagtttaatctttttaaagcaagattatgattatatagtagtagatactaatcctagtttagattttactttatcaaacgctttaataactagcaattgtgtaatagttccaatgacggcagaaaaatgggcaatagaaagtttagatttattagaatttcatattgaaaatttaaaaataaaaataccaatttttcttcttgtgacaaggtttaaaaaaaacaatactcataaagaattattaaaatatgttgaatctagggaaagatttttgggatttattcatgaaagagaagatttaaacaaaaaaattgcgggcaataatgaattcaatatggataaagactatattaatgaatataaagaagcattatcaaaattttttgagatatattaaaaaatttattataaaaaaaatccagattctggacttttttgaaataaaggagattttttatgaaaatagaattaaataaaagaattttggcatcagggatagatcccgatggtaaaaaagaagtgattaccaatgaagatagaattgctcattataatgctttgaaagatagattaaaggctaattttagaaaagaaatatatcataaattggatagcatcaaaattttgaaagaaataaaggataatcaatattataaaattgatggatataaaaaatttgactattttataaaagattataaaatagctagaagtcaagcttataattacttaaaattagcaactgcgttgcaagaaggaattcttaaagaagattatttaatagaaaatggcattcataattctcttgatttaataaaggataaagaaagtccaacattaaaaaagtctaaacaaaatccaataaaacctctaagatttcaacttaaaaatcaagaaagttatgatttttataaaagcaatgctaaatttacgggattcttgttagataaattatttatggataaaaaagaaataattaaaataattatgaaagaatataaacaattaaagggataatatggaggttgtatgaacaatttagctaacagaacgtttaacataggaaatataaaaaacgaatttttagaaataggatttagcgaagaggcaatagattttgtttttcttcataatgataattataactttgagtttttaaaagagaaattgattaatttagagaagaatttacaaaaagatatatctaatttagatatcaaaataaataatgttaaaaacgaacttaatgctaaaatagatagtgtagagaagaatttacaaaaagatatatctagtttagatatcaaaatagatagtgtagaaaagaatttacaaaaagatatatctagtttaaacaccaaaatagatagtgtagaaaagaatttacaaaaagatatatctagtttaaacaccaaaatagatagcgtagaaaagagtttgcaaaaagatatatctaatttaaacaccaaaatagatagtgtagaaaagagtttgaatcaaaaacttagcatgggtaacagactagtacattttatgataataacagcagcaattctaggtccaattttaaatgccctatttatgaggtatttacaatacatcaaataatgatgtattgtataatttgatttttaaaatggtacattataatattgatgaagagtattattaattaacacttaatttttgctttttcataaagtagaacttatttaaattttttaacaagataacttaaataagttcttttattttaacaaatacaaattgattttaattctaaattggactatactcaattattgaaaagctttttaaaattattttaataagtgaattcggttaaaccctagctttattaagttctttaacaagagaatttaataaagcttttattaattataataatttctgtaaaaagttggcaaaaaacaatttataatattattataaatattataggagggatatgttattataaatccgatttagtttgggcttaactaagttcttttgtttgagaatatagttaagctcttttttttataaaaattgttataaaaagttggtaaaaatagtttttgttatatatatgtatgtgaatagctaaaaaagtgtattgctatcaaaacaatccaattaagttgggtttagctaagttcttagacaagagaatttaaataagcccaactattttttttgtaaagatttttgtaaaaaagttggcaaaaatagtttttgctatatacttatatttattaatacaaacaaggaggaaaaagatggaaaatctttcaaacaataataatccacaagaaaatattcaaggagagctcaaaatgataagtattaatcaacaaagttttactggttgtgaaatatttgaggaaaaatcttctcccattaaagaaaaaagtaaattaagtaagataggcaagaaattgccaggaataagtagtcaagaatgttttagatttaatcgcaatattgattttagtgtgcaaagaaacaagttagataaatacggtgctagtgaagtaggcaatattcttgttggtggtgcggggctgaaagatttaatgataaacagagtgcttaaatattttaatatgagtctaccttttgaagaaaatttatatatgctcaagggcaaagagttagagaatttaggatttagagagtttgttaaagcatacggtgataatattgatattttatataaaaataaatatgccaacggagttgataagtataattatttcaaaaaaatgggcagttcagaaactttagtgggctcaacaattgatggctggtttattaataataatggcgatttagaactattagagattaaaagtagcgactctaattatatgagtagtgctattgctgagtacaataaaaatggcaattttttaagcagtaaatattttttcaaatattatgtacaagcacaaatgcagctagcatgcactgggcttgagtattgtaatttgttctttttaatagatgctgcaccaattaactgtaagattaaaagagatgaggccttaatatcaaaagtgtttgaatttgttaataaatgtgaattagaaattataaatttgaaaaaagatatttatagtaactatagagaggaatacttaatggcacataattttaacgaggatacgtttataaaacttgttgaagatttagtagaaaggagtgatttttatagttctggagttgagtttgattgggcaagagaatttatagaatatgttgattgtacagaccttgaaattaaggataatcaatctgctgaaaatcttgcgtatgatttaatggagattgatagtctacaaaaagaattaaatagaatccaaaacgaaaataaaaaaagagaaaagcccattaaagataggttgaagatgctaatttacaatattacaaatacatatccactaattgagcagctaaattataaatttggagagtttgtgtttactcttgaccctaagaaaagggcaatatcagatagattgaagggactactaccaacaagtggtacagtatttttccctagcaatatagcatttacaaatagtgttagtgtccccatgtgaatgggtgcactaaaaaattaaaaaaataaatttaatataggaggattaattaatgcttattaataaaataaaacaagataatagaactttaagaccggagatacaaaaatggggttgttactttttgtgtctacattattatacaagcctatttaagaaacgtgaatttaatgcttatgagataaatgcagcgtattatagatttataggacttggatacattaagagtaattgttttattataaatccatgtatgatacttaattattacggaattagaagtagcgtgagatatgaatctttaaattatttaggtgcagccaatgaatttgaaataagtgaagttaaaatcgataaggttaatggatatcactttatagcaacaaaaaataaagaaatattatatgattcacttgacttgaagcctcgtgggaaaatatttaaagtaacttcaaagcgtatatttagactaaagtagtttttttaaagtttaaggttatttttcatgcatttataagcgtgaattttgttagcagcagagaggccgtagatattatcaatttcggaagttgaatgatatttcataagttctttaatttggaaagaattataaccattagattttaaatatgaaataaacaaatttctaaataaatggagagatttattggcacgaaatcctgattttttgagaagatttttaaattttctagaaatattgataatatcaatttggttatctttaaatttatgtttggttttttggaaaagataagtacgccgtgagtcaagatttttttcgttaaaataattttcgtgagctttttgaatagcctcaaattcttcagatttgatgacaatttctctaatacaagtgacatttctttttttagctatattaacttttatattgtaaaaagtttctccagttttgtttaatagaggagtaatatcttgcatttttactttttgaatttcggcccccctacacccacttattgcgagtagatgtagaaaccaaccagaaatagggtcaattttttttaatgttttaacgcatttttcaattattttgatagcttttggggtcaaataaaacttaggagttggttttgaagcttttttagtaggcttagaagaaatttttagtgaatttttaagaattttattttcatttagcacattttgataatcttgaaatagtttgagcataaaatccatgttgaaattatttaaattaaaataattattagtgttcataaaatcctctccttgaaggtgttacttttaaattaagtaaaagtaataaaaatagataaaaatagtaatttatattgtaccaaaaacgaaaaattttagtcaaattttgtgagttctcattgcatgagaaatttgggttgtagggaggctgttataaatagaatgggcattttctgagggtgtcggctaagaaagactacatactttagctaatatatagcaaagactttgaaatttaatttgtatgtgttttatagtcttttgtaatgagtagtgcatttgcaatggagagattttggggagttgtttaaaattacatttgcgttttgttaaaatgtaacagctgaatgtaacaaaattatatatttaaatctttgaaatattgcatttattatgtattgtggtatgattaggacttatggagaaatttatgaataagaaaatgaaaatgtttattatttgtgctgtttttatacttataggtgcttgcaagattcatacttcatatgatgagcaaagcaatggagaggtaaaggtcaaaaaaatagaattctctgaatttactgtaaaaattaaaaataagaataatagtaataactgggcagacttaggagatttagttgtaagaaaagaaaaagatggtattgaaacgggtttaaacgctgggggacattcggctacattcttttcattagaagaggaagaaattaataactttataaaagcaatgactgaaggtggatcatttaaaactagtttgtattatggatataatgacgaagaaagtgataaaaatgtcattaagaataaagagataaaaacaaagatagaaaaaattaatgatactgaatatattacatttttaggagataaaattaataacagtgcggggggagacaaaatagctgaatatgcaatatcactagaagagcttaaaagaaatttaaaatagaagttagaaatataggagagagcgtatatgaataaaaaaacaattattatttgtgcagtttttgcgctgatactttcttgtaagaattatgcaattaaagatttagaacaaaatgcaaaagggaaaattaaaggatttatagataaggctttggatccagcaaaagataaaattacttcaagtagttcaaaagtagatgaattagcaagaaaattacaagaagaagataaaataaagggtgtagaagaaaacaataaagatgaattaatgcagggtgatgatcctaatagtggtgtaataaattcgtcaccagtattgccagaaaatagtcaagataatacaccaatattaaaagcagcggaacaaagtgatggtcaacaagaagagaaagtgaaaaaagtagaagaatccgaagctaaagttgagggaaaagaagaaaaacaagagaatacagaagaacgaaacaaacaagaattagctaaacaagaagaagaacaacaaaaacgaaaagcagaacaagaaaaacaaaaaagagaagaagagcaagaaagacaaaaaagagaagaagagcaagaaagaaaagctaaggcagaaaaagaagctaaagaaaaagcagaaagacaaaaacaagaagaacaacaaaaacgaaaagcagaaaaagaaagagaagaacaacgaaaagaggcagaaaaaaggcaagttgataacgaaattagaacacttacaggcaaaatagatgaaatcaatagaaatattgatgttataaaagagcaaactagtgtgggggcacaaggtgttatagatagaattacagggcctgtatatgatgattttactgatgggaataaagctatatacaaaacttggggggatttggaagatgataacgacgaaggattaggaaagctattaaaagaattgagtgatactagacataatttaagaaccaaattaaatgagggtaataaagcatatattattgatactagaagcactgaaccccaattaaaagaaaatgtaagtgttagcgaaattaaatcagacttagatgaactaaaatcaaaattagaagaagttaaagaatatcttgaagataaagataattttgaagaaattaaagaatacgttgctggtagtgaggataattatgatgaagaagattaattttagatataactaaattttgtatacacaaaataacaactagtaaaaaaatgactagttgttatttttttgtagatttcattgttataaatatagaaatgttttctatcaaaactttcattcaaaaaatgccaaaaactattgctcaaaatattgtttatttatatactctctagagttatgatgaatataaatgagatttcagatttttatgataatttatataagaaaacaaaaaaagaaatagataaacttataaacaagctctatttaactagccaaataactctaaagcaaaaaagacaaatatacagtgctgttgaaaaaatgcaaaagtacgtaataaaaaccggaaaaagtgtttttttagaatcggaaaaagaatttgttaaagacactttgaaaagaaaaaatctaacaaaaaaatttcaaagtttcaaagttgattttagctacaaggaaggaatgctagaaaaatgtttagaaagattaggagaagataaatctatcgaatttttgatttttgtttgccaaattcttaatgggataagagaaaaagtatcagaattagactttcaaatagatgcgattaaagaatttagagatattttatttttgagtatacactattatgataaaagacttttcaccagtaagaatcttatgaatgaaatgaaatactttttcgaaaaagtagagttaatttatagttatatgcaataaattagtgaactgctatttctaaatcaaaaattatagaaatagcagcgaactaaatcaataaaagctaacagatattccctgttaaatatcaagaagttatcagtttatgttaacaattaacaaattgctttactatttagagtaacaaattgttacttttgttattttagaggatttttttgaaaaaagttaaaagatcttttgatgattatgttgcatattttagagaaggatcgttaagtgatgtagaaatagcgaagaaattaggagtttctaaagtaaatgtgtggagaatgagacaaaagtgggaaagtggagaaagtgttgttaacggggactctagagtaacaattagtgaagatacttttgaacaccttttgtcgcaaacctttagatcagaagttaacgctaggaaagttagaagcgaattggatgtagagcggtctaatttagaattaggatttataaatgcatttaagcaatattctagtgttgagctttttagtatgcatactaaaatagaaaatttaagagccgaaattgacgctttaaataaagcaagtagtaaaaaaaacaagcaagttgttaatggagaaattaattctttaaaaagcgagcttgatgaatatataaaagagtgttcaataagagaaatggagctttactatgaatgtatgaaaaaacttgctacggttaatggagctgaaagcaaaagtaactacaaaaatagtaaagggcacaagtgaacttatatcaaacaaaactttttacaacactacaaaaggaatacaaaaataaatatggagttgatatatcacaatttgtaaagctaacaaattcttcaattaattttgataagtttgaagaagaacagttaactttaaaacaaaaaaatgtgataaaaagcattaaaaagaataatgaaaagaagattatactcagcggaggcatagctagtggcaaaacgtatcttgcatgttatctttttctaaaaagtttaattgaaaataaaaagttatactctagtgatactaataatttcattatagggaattcacaacgttcagttgaagttaatgttttggggcaatttgaaaagctatgtaaacttcttaaaattccttatattccaagacatacaaataattcatatattctgattgattcactacgtattaatctatatggaggagataaggcaagtgattttgaaagatttaggggaagtaattcggcacttatttttgttaatgaggctacaactttacacaagcaaactttagaggaagtcttaaaaagactaagatgcgggcaagaaactattatttttgatactaatcctgatcatccagaacactattttaaaaccgattatattgataatatagcgacctttaagacatataagtttacaacttatgataatgtgctacttagtaaaggatttgtcgaaacacaagaaaagctatataaagatataccatcatataaagcaagagttttgttaggtgagtggatagcaagcactgattcaatttttacacaaataaatattactgatgattatgtatttactagcccgatagcatatttagacccagcatttagtgttggaggggataacactgcattatgtgttatggagcgagttgatgataagtattatgcttttgtatttcaagaccaaagaccagctaatgatccttatattatgaatatggtaaagactgttatagaaaatttcaatgtgcatacactgtatttagaggatagagataatacaaaaggtgctggtggattgacccgtgaatacatcttgctaagaagtaatataagccaatattttagaattgttccagttaagccaaagtctaataaatttagcagaataacaacgttaattacgccgtttacttacaaaaaactttatattacaaagtacagtagttcttccgtatttaatgatatttattcgtataagggggataataaaacccatgatgacgctcttgatgcaatatctgcagcatatttgatgttgtctttaggatatagagagcgaagtgttcactttggcaatcaaagatttttgtaa

SEQ ID NO: 208 - DNA, 29838 bp, Borrelia burgdorferi
attttattgacaaaaatattagtttttgctatcatacatctaatttaataaagagaagtaaaaaggtgtgtgatttaagaaaaacaaaactaatagataaaataagttcactagaactatacaaatactcaatattttttagaaattacattgaaaatgtagcagaagattgtctcaagaacggacttattcttgagagtgctgctcacaatgttagtgaggttgaacttgctaggttaaaggtacagcttaagaatgctctgcttaattgtattataagctaccgttttcatgggattggctatgttttagtaaaaaccaaagataccctaatagatctcgaacaacccgttaatatagaattacctattggttttgaataccttgattatgaatatgtaagagatttgggagttgattttgatcatataacctataaagtaaaatccaacaataagaacaattctttagacgcagttaaaatacataaaagtcgacttatcatatatgaaaactttgattatatcttaaaaagatatgttccgtgttataccgaaagctttttactagatatttatttatttgaaaagatatacgtagaaatagaaagacgtattgaaaaccacaattttttgttttacaaagatgaatctttagtacaactacaagacgcactttctagtgcaacaacttctttaagtgcacttactcagagcaataatgataggggaagtggcattttatcttcttttttgagaaaacaaaattcaaacaatcatagtaaagatatttctaatttaagaaaccttaatgactcattatcacaggagcttgctaggctaaaaagcaatctaaataatgagggaatgttttatacggccacccctagtgctagtttagaggttattaaatacgatcttagctacttaaaggaggctttagcattaattaaggcaaaaattggtgcagatactaaagagcccttaaccagaagttttaatgagcaggctaaagggctaggaaatgatggtaaaggtgataggagtaattattacgattttctcaaaggtgtacaagaacaagttgagaactcttgtaatttaaaacttacaaagtattttgggcttgatatgaagtttaattcgctgattatgttaagtgaagaacaaaaagtagagagagatataaagctaattgagctttacagtaaatataaccagcttatacaaagtagctcatttaataatgaggagctagcgatgttaaaagagaaattattctcattttgagaaaaggagttaaaagatgactgagaaagaagaaaaagaagacctgcaagcacaagataaagaagagcagcaaattaaggctgatactaaagttatcagtgtgcaggaatttgaagagtacatgcgttttaaagagcaggcaaatagtaaatctaaagagacaagtcgagatttaagtataaatgaacgaataacaaaagaacttgcagaagttgaagagcgggagcgtattgaaaagcaattgttactagaggctgagcgaattaatgaaattgatacacttgcaaaagcacatcttagcaatcattttaacaaagaggtgctacttgcaaaaggatatacattaaaagacattatgcaagcacaacgtagagaacttgtacgcaagttcgttccaattgagcaaattaaagctattgccaaagtatcagacataagtcatatagatggggagatattagagcaacttgtttctttagcaaaagtgaatattaaattaagaaaaaatgcgagtagcaattcttcttctgttgactctattaaggggaatattgctattaaatcagaagaaagagcaagtttgcttaattctaattttgtacctattaatttcacagaatttgtacaagcgataagtaatacttacaagcaaagacgaattcaattttatgaaaatctaaaaagacataaaagaacaagtattgcttaaaggagtttttaatgagcgatggtattacaaaaataaaagaagagtttgataaaaaagttgcagaaattaaagcattaatgaaaaatcctcagcaagatactggtttgcttagtaattctgtagattttagagataaaaatctaatttactccaattcggatggagtttttactagtagtaaagacaaaatagaaaattatcctgctaaagggtatccatacaagcgtggagtcaagcttagttttagtgcagatggtacaacagaactagaagttgaggctggtggtggggatgacttgtacggaatatgcactgatatagatgagtttactggcatggcaactgtagttccaattacaaataacttcacggggtatttaacatttaagaaaaatggaaatggtgtaaacccaggtgataagctgcattttaatgcacaaggagagcttgaaaagaatgggggaaatgataaatctgttaatgctatagcactttcaaaagtacataaattaaccgaagagttatctatagtgcttgctagtgtttttgggaatagagctttaaaaggtaattaaattatggctttaaaaggcaaagggcaagctaaagctcctaatgttgatgataatccacaattagggctagaatcagaaattccagttgctcctagatctaaacgtcaaacaagacaggctgaagaagtacaggcaaaagatccttatttagattcagttaaagaacttgacgatgttcttttaaaatttaaaaaatattcaaaatcaatgagttcgattgaaaataaggtttttagtagttcgggtggttgttttaaatcaaagaatgcgcgagttaatgcttattcttttacatgttcaagctttgcagacaaaatagaagaatacctttatgatccagcaaatagttttccatataagcgtggggttaaacttgttccaaaagagaactctatatatgttgaagttggtgctgatactgatatgtatgggatatgtgtagatgtatgtgagtttagtagtactgcgtatgtattaccaattacgaataactttgaagggtatcttgttacaagaaatccgagtataaaaatgggagaaatattggatataaataacaatggggttattatcaaggctggtggtgggccaccaaccgtaattaatgcatatgccctctctgattcatttacaatcaattttgcacccgaagatgaatatcaagatcaagctagatatcccaaacaagagtattctattaatttgataaaagttgcaatttttggcaatagaggccttgagaaaacagtaacacctgaagctggtggttaagccttgggcaataaaaggagttaaacaaatggcagacacaacgcaattagtaaaagattatcaagagaagagaagtaaacttgaaaagtttatgaaaaatccccagcatgacgctggtttgcttagcaattctgtagagtttagagataaaaacatacaattttttgcctctggaggcactagaaccagcaaatttgacaaattagaaaatcatccattttctgggtatccatataagcgtggggtaaaaagagttattcaagaggaaaaagctgatcaaattcactatgaaccccacgttgaggctggtggtgaagatgatttatacggaatatgcattgatatagatgagtttagcaaaacagccactattgttccgattacaaataattttgagggttatttagtagcaaaagattctacgcttaaagtaaaagacaaacttgtttttaataaagacggtgctcttgaaaaggtgactggagcaccaccaaataaggcaactattaatgcaatagcgttgtctgatgcaaaacaaattagtaacgatgtttatttaataaaagtagcagtatttggaaataaagctgtaagtaaaaattaatgatatttgggaggatttaatatggaattatttgatgaaaattattatgcaaaagctgtggcaaatattataggagaagttaaagatcctataatgtataaatggttttcgcctgatcaaattgaagatgttgatcttcagatgggctaccaaagaactgtaaagtgggatgcgtttttaaatgctaatcctacaacgattgctaatgaggttaatactatttcaactattggatttagttctgaagtggtaagacttaattacttaaaattacagtacaaatttaggcacttaaagcaggcgtctgaaaaattttacacttcagactcatatcttggtgacattaataacaatttacttcctttctctcaagcctataagcttgcaagtagcgagattattaaacttattaatcactttgtactaacaggcactgtttcaattcaaaaagatggaaaaaatcaaaaacgtctacttcccaatatgtatggacttcttaatatgccacatcaagtaaaagaagaagttgctagtggtgataaagataaaatggataaaatatttgaaaaaattgaggcgggactttcaaagttagagctaggagacgaattttctacacctatgatggtaatagttgaccctacaacttcgctcaaactcgtaaagccatacgcagcagcacagggtgcagcaagtagctgcgaaaaatgggaggatgttttgattcaaactatcaaggctattaataatagagaagatgtctacattgaaacttcaaacttgctaaaacatcaaatacttatttacccattaaacccagagcttattaagtttaaacctagcaagtatatgttacctacaccaaatgaacaagtggataaagattcaactgatattgctcattcatacattgattttgttttaggagggttacttgctactagaaaaactattttgcaagtacatattaaacaaagttaaaaacataaggtaaatcgaggtgagcgaacaaaaaaacttacaaacacaagttgaggctgaagaagaacttttggtaacaaaactttattctgaagtgttattgttactaggaatagacaaacttgcattaagcagacaaaattttctacttcatttatctttacttcaagctattctagtaacacgtggtattgatgctagttcacttacatatgaacaaatatttttacttaccttttaccatatgggttgtcaattaagaaaacagggagttgttcgagaatttgaatttgataggatcaaaaaagagaaattcaatgaacttgaacttgattattatcctagtagcagtggaggcgaagaaggcggcgaggggggttgtggctcaaacaagaatttttgttcacaacttgatgcatttttagaaaaactaaaaagagaaacttcaacgccatcttgtgtgggggttgtctaatgaatggtgttagaaaaagactttcagatatgtctttccgcatgatcaacgtatttaaggatcctcaacctttaaggttttataaaggcactgttgttaaacttgaaaacgattcttcttatcagagagtttttgataaaaataagtacactgaatttgcaggagttattattgacataaggccacaagaacttgcagtgctttatgactctgatatgtctgatattcaaggatattccaaactttacacatatcaagaccttaactatgaactaaaagaccgcatatcaatttcggatttaatttactttgaaatatttagtattgactcttcaatcggatattttactttggttttaaaggagtttatatggacaaactagagtttaaaatggaattggaaattgggtggtttggtggtcgtgcagggattgctagaatgcatgaaaaagggggtagcaatttaccagcaagaaaacatttaaccaaaattgctggtagttctgaatttagagaatatatcaataatagttatataaattctaagtttaatcttgaccccaaatcgggaatggaggctattggacaagcttttataaggtactatggaaattatctattatcagcacaagtctctccagccttaaaggctaatacaatcaaaagtaagtttaaaaagggtagtaacaccgcagcaattccacttgttgatacagccaaaatgttatccgagattacttataaggtaacacttgaatgatttttactttagatatggttttaaaccatttaactcaaatattcaaagggtttaaggcgtatgcaactgaaaataattttgagtgcgatatcataaatacttacaatcacccgtacctttcaaaaatcacagctgctagctcaaatataatagcattgaaatttgatggtacagaaaatctatttgatcataattctagagccggtgcattttatgaaaatgctttggaattcagtttaaattttcaaatatatattattgctatagtgttaaacgctcaagattttgacgctaattcacgtatgttaatgctttatggtatgcttagcaattttctacacaataaagcccataagtatactttagaaagtcaatcccaacccgaatatattagtaaagttaacttttacatttatccaatatctaatatgcaaacagttgggcttattaatttaggcacaaaatatagcaaccatgcatacagtgcatctatagcatttaatgctagtgtaaaagcaattgaaattttaaaggaggaatacaaaattgccgcaagatacaattagtgtaagtttgcttgactctagaattcaagctagtaggcccaattattataatccacttttggtttacaaaacagccaaaattaaagttaataaagatgctgctaactataaaatattgaatttaaccgttaataactatgaaaaacaaattgaaactttagaaaaagataatgggaatggacaagatcagtttggaaaagaaaaaacactgcttaaaaccgcaatgtcgaattttttcaattcaagtgaagaatcattaaaatcagccgatctttttatttataaggataaacccgaagagttaaaaaaatatcttaaagtacatagacacacttttgttgtacttattaatactgagggtgataattccgatgatggacttaagatttataaagatgattatgataagtttaaaacaccttcaattttttttgtattctcaactaaagaacaagaaataaaagaactatttaaagataaaggcaatactgaaaaagaaagaaatattgctgtttacagcaataataaagacaatttacacctcaaatttataagtcaatatttacatcaagctagtatttttcatgctgtaaatccttatggcatgccgctggctgctacaccacttgttgatgatactgtaattggaaagttgagaactgcaaaaatcaacttttattcacttcttaatgaaactgggcttgatggtgtacccgcatttaaagaaggtgttgacctagctggaggtgcaatagacgaacaatttacataccactatataaaaaatgaagcgattattgagcttattagaatttggaacaaaaacaatagacaaaatagcaaattatctgcactacaacttagtggagctagagacaatgcatatacttcagcaattgaatgtttactgaaaaggtttgtggatagaggactgataatagagtataaaaatttaaggcttactctttctcctacgccacaacttaaattagaacttagcgtgaatattacttataactttagcattaatgctgttgctttagtaattactactcaagatatagttgattatcaaaacagcttaagtgcttaaaaggggggctaaaaatgcaattttatgatttaagagaagtttatttttcaattggtggtacgcagttacatagtggcaagctagagcttacaagcgaacctacaacaagagcagtgattagtagtgaagataaaggtatgcctgtaataagcttaagagatcccaaaacaataacttatgttttcaacattgaagtgacactaggtagtcatgactacattttgttaactgaactttctgatgaacagttttacaacatggatgtgagaaaagaggataaaatgcttgatttagcattcaatgatagaattgctaccaaaattatttctaactatgcaatttttactgaagagccttcaagaagttattctgctgaggccgaaaaagtatcttttgaaattagggctattaattgccaaaaatctaaaccaaacaactcttaaaaggagattcttattatgataatgagatataaaatgaaaattttaactaaaaataaaacttatgaatatccgctgagagtacttcccgtctatgaatgggataaagtgctaggatttaatcaaagtgacgctgttttaaagcttaatgaggttaaatacttaagagaaatcacaagcttaatgataagtccaaaatttttagacgaattctatgtgattttggatcaaaatagagaatttatttcttattataaggactatcttgttgcaataatttacactgcacaatttaatacttttcatttagacaatgatctaaaaaagcccgctttagtatatttgagtgagtatgaaaataatgttggtgattttgttgcttttgactatattaatgaaaattttgattatgaaaaagtagccacttcactttcatcaagtacatcaaattccaatgagctggttgctaaatgagcaaaagagatagagatattgataaagctattgcaagtcttaatgagactagaaaaaaatattttaacttgcttgacgagattaagaacgacaaatattattttccagtaattatgaatatttgctcgtacgacaatgtaaagaaattgccttatgacgagcttttagaggtcaatagacttgctgagattaaattagaaaaagaattgtatgaattaattttaagcaagtgagggcttagtgagcgacaaattcaccattaaatttaaagggattcttgatcatgctgcaacaaaaaaggccattgaacaagatatttctaaaatggaaaaatatcttaaacccagaaactccagtttgggaagcactaaagatattgtaaaaaataatttgtcgaacaagaaaaaagaacttagcaaacaatctaaatttgaaagcttaagagagcgtgttgagaaatatagacttacacaaactaaaaagcttataaaacagggcatggggtttgagaaagccagaaaagaggctttcagaagatctttaatgtctgataaagacaaaagacgccttgagtataaagaacttgcaaaagaatcaaaagcaaaaagtaaaatgttagcggcctctcaaggaaaaggacttgttgccaaaattgcaataggcagtgccctaggtaatatcattagcaacgctatgagtaaagttgggggcggccttttgggttttgctaaaaaagcggttgaagaagacaccaaaactaaaagaacacaacttctcaataaagcgttttatgatgatccaaaagagaaagagggtcttttaaagattattggcggaatgaagggatttgagcgcgacttagaaaaagaagaattcttaaatcaagcaagtgtctttaaggggactttaagggatttagatatgttaaatgaaactaatttgaaaaacgcagtagaatttgcagctatgcttaaatccagtggtgctatgagcagcgaagatgcagtaaaggctgttaatagtgttcttgggggtgatggaagtgagctttttgatctattaaagaagtcaggtgttggagacaaatatatagaagatgccaaaatggcctggcaaagcggggcacaagtagatctagagtctagaattaccaagatgatggaaatgttcgaggattttaaatctttcggccttacaaaaaaagtcaataatgctgagagtattcaaagtaatttggcctcagctgagcaaactcttcaaaacttaaccactactgtcttggacccattacttgacctcattaataagataactaattactttaaagactttgcgtttgaaacacacattattaatcccataattaatggcattaaaagtatttttaatcttaattatttctttgcaaaattaaaatcgatgctacctggatggatgggcggagatgagggtgcggctctaaaaaaactacaagaagaaattcaaaatcaagacaatgctaacagcacaccataatttttacaaaaggtaattacttatgacaagtaacaaaaaaattgctaacaatgcagctaacaaaatagatattaataataaaattactaacaatcatgatattgaaaagaaaaaaatcaaggaaaaaatcaatgatattgaaaagaaagaaatcagggagattactcgaataataagagatgtaataacccaaatatttgcccttttcggagcagataattttttagtgttatttcctagaatggatctaaaaggttttggatatattcctcaattgttttttataaaaccaaaaaatgaactcataacacgcacttataatactagttgttctaaaagaccagttatcaattattatgatagaaaagcggaatatgtaagctacaatccggtaatgactggtgaacatatctcattaaacgggggaatactaacatccttatataaggatatgatttctttactcaaaatgactgtttttggcaatactatgctacgctttgacgctcatcttgtaaaagaacaactagccaatagaatacaagcacaagtcccttttagtatatatagtccaacttttggccttaaagaattagctgtaattacaagtctttcgtttaaagatactcctttcattgacgaagttgaggttagtctatcaatagaaatagtaaaaacatttgcattggaaaaatataaaggataaaaaatgctgttactacaatatgattttaaaattgagttctacaatgtagatacatcaaaaaaatcacctgatggaattcctttcgccgaagaaattcctaaaattatcatcaatacacaagatggaattcatattgatatttccatatccaacgtgtattcaaatattcatactataagttccaaacaagcaaaagtcgtactttggaatcttcccttagacttcaccgacgacattaaatttggagatatagtaaaaatatattataagaaatttgctcatgaaaaaaattttgatttcataatggcaggaactttaggacctcctatgagtactgattatccgggtggggattttagtgtagatcttgatgttcgtttattaactaaaagcaacttcttcaatcgtaagttggcaggcaaagaaggcaaaaactttaaaggcaaaacggtgcaggaggcaatagaatctgtatttcccaatcgcaatatccttaatatggatgaaaaagattgtcttaaaattattgacaaagatatttatgccacaacaccaaaagagtttattgacaaaataaaaggaacatatgttcataacataatagccgatattggtactggtttacggggatatgaatgctatctgatatttactaattatataaaaaagggggaaaatgtccactacgaggcattagaagactatgggcttgaatttataccacaacaagaaattactttgggcacaacactcaaaaaaaatcttatattttggaacgcaaaaacatttttcacacataagttaaatgttggagataaagtctcatttattgatggactagggaaaatgataaaaaccactataaaagaaacaagtgcaaggcttagcaatacaggagagtgttcattaatattaaagttagaagatgattctaatacaaaacgtaaaaaataaagggggctagaattagaatgaatgaagactatgaaatttacagaatgaatcaacgcctttatggccaggcattggctcaagaagaccttaaaaattggatttattcaaacattttcataattaaaattggcactgtaaaggagtttaaacatcaaactcaagaagctattgttacaatacccgaatttgaagatttagaaattcacacaaaaaatatctctaatatcagtttagaactatcaaaaggtgataacgttttactgcttcaatcaagcgttaatatttttgataaaaataacgatattcactttgacaaacatcatttttatatacttagtgcaattagcccaaagactttaaatctaatctctgatactgttaaaattaaagcaaacaataacattgaaatagctaaccaaacaactagcttaaaaacaattctcaaaaatattgtaagtgctattgagggtataaaagtcgtacccgcacaaggaggcccagcaattgaaccagtcagcctaaaaatagcaaccactaaaattaattctgatattaatagtttgtttaagtaatttttgctaaatatggtataattactagtatggatttaagattaggcaataatttcgaattggtatttaataacgatttatcacttgttgatggaattgatgaacaaaaacaaagatttttgatatttttaaaaaccttaaggggtagtttaagctatgctcctcattggggactggactatttcttgcttttaaaactgttaaaaattaacaatcttcacgctgtaaaaaattattttcacgaaatatctaaagaacttaacttagatttaataaatatttcaactactatacaagacaacaaagcacacatatccttttttttctcaggcgatgttttgaatatggagtttaatttatgagtatagtttttgattctgattttggcattttaaaacgtacaattaaggatattgtaagatcgaaaagagaatatttgcgtgtaaattatggtattaatattgatgataaccaaagctcaatttataacattattgcgtcttctttagcattaattgaagaagaaataattaatgagcttaatctctttttttctaaaatgaaaccgggtggcacttattgggctgctattgaagaacacatttcttctaaaagcacaacttacagcgcggttcgcactgctttacttaatcttgatggggttgagcatactaatattaaaagtgcagctggtaaagccaacatatatctaattttaaaggaaactttactagacgatagtaaatctaatattaatagtcctaaatttaaagcaaaactttgggagacattatatctaacaactcctagtgggactttacttgagggagacatcgaaattgatggcctcaattcaactggacaacggaaatcctataaaatatcgctagggaaaagaaaatatgtttatatgaaagtaaagtataaacttgaccttaaaaactacctctacttaaatattgactctcaaattagggatatatattctaggattatttcaaataactattctgatatgggaatcagctttgaatatcaagacttttttgctccagttaatgaagttaaaggaattaagtttatggaaataagtgcttgtattaaagatacagacactgagagtattacaaaaattggtgatagcgattttaaaaaaaatcaagatattgccattaatgatgacacaatgctacttttcaatatgacagatagattgcttattgatattggatagttaacaaatatgaaaatacccaatcttttcaaaaacaccgaaattcataaatttatacgtacagaaacagaatatgcacaagcattgcttaatgaacttaagtcccttaattccaacttcatgtccattaatgtaatagaaaatataaaatcaagatatattgcaatatggatatctcaagttttatctatcttttatgcaaaaactcaaactttacaaagtattacaagcaatattaatagtgttatttttgctttacgtcatattggcactgacgagtcatttagactgattttcaagacctttttaaatgtggacattgaagttactactcctgaagctggggttattgatatctctttaaaaggggtaataaaaacaaactttactacatttatttcgcctagcactaagaaaggaaaacgactaaaaaagataattcttagagaaaagaagccgggatacgctgcatctaaaaaagctttagtatttaactcacttcctaaaggctatgatcattcaatttatgcttttataaagggaattattcctattggtagagttctcaaaattaataatacagatggtaacaatattataacttttaacaactaaggaggttttatggctgatgatcaagaaaaattactaattgatgaagaagaaacggttcaaataaaagatttaaataaggttacgaccgttaacgatactgatcttttactgcttgatgatggagctgcaagcagtaatgctatcacctttaaaaactttttagatgcttctaaagacaaaatatttaaaggagaaggattagactattttaagcagataattaagtctacaattgccgaagaacttgcagctgataaagattttgtagaaaaaatttatgctaaaataacggacaaattaattaacaacgattctactaatatttctaacctttttagtaaaattaaatcacgccttacagatagcatatcatcagccactttatctagaagtgatgatcttttgataatgccttcatcagatactattcaaaaaacacccgttcctaaacatatacttggagtaccatcaaattttgcttatggcagaactagaagtactacactttatccttctgactatgagaataacgcgatatctattaatatggaatacaatgatgatgtaactcttattttttctaaaagttacgataattctcccgtttatcttgatattgaaattcaagtaaaaatcaatgataataggatgcagaaaaaatcattaaaacttcagtattctgatgaaactacatacaatagggtttatgaaattgcgggcccccgcggactattcaccagaattcccatttataaaggatggtatgtccaaaaaagagtctccttgtatggagatccattcccagatcttttaaaactgtaaactttttagcaaaaattatgattttggtatataatatacgtataaaaataaaaaattaaaatgaaggattaaaaaatggatactattaaattaaccgaacttcttatcaatttaaacgaaattaaacttatagcggtaatgatttttgtaacagtgctggttttaggagtattaattcttctcaagcctttactaaaagacatattgactattgtaataggcaagatttttaagaatggtaatggtaatggcaaaaatcacattaaaaaaagagattaacttatgaaattatccaaagataatgttgagcttggacttacgtctttatcaacccttattgatatattttctaaatttgaagatgaatttgatgaaattgcacataaaggattctttttggtttatgatctgtattctcattacaaattaatctatacagcaaatatggaaagacttgagagtgcattaaccccagcaataaatgcggcactcgctccattaaatgaaaaaatcaatcaatgcattgacttagttaattctgatgaaaaaaatctcaaaatatctaatgatctgaaattcaatcaggaaggaaaacctatctataaggaaagaataaataatgcaaaataacactattggtttaggacttaatttactatccagcttaactaacatagctaaaactgatacaaacatagatcataattacattaatacttttagtaaagtaatagattttttctacaaaacatatataagcacactaaaatctatggaaacagctgagtcaactaaaatatttgaagaaatacaagacattttaaaatacaacattgagataatagaggctatctctactgataaaagcaaaagaattatcacttcacttaaagcaacacgtaacaaaatcatgaaagaatatatcaaaatacttaaaagaggtgaaaatgcttaaaagattgcattgtctactaattgctttgctgctatgttgcaccactattgctaacctaccagaagagccaaaaccgccaattattcaaacactaaaatctttagctaaatatgaaacacaactttcagagtatgttatgtaccttgtaacatttttagctaaaacaaaagtcaaagttaatgacccaaattatccagaatatccttatccagacttatcaacactaaaagacgaacactccataactgcagtaaaacacaatatcaacatatatttagagtacattaaaaaaacaaaaccaatagcggaaaaagtctataataaatattcccaattaaaaatgtaaattacaaaaaggtttttcttgcaagaaattctactttataattaaattggcttttacaacagaagaaaatctagatattaaatttactttaatctaatatctagattttaacattttcaacatgaatatttactaattaattagtgccctcttcgaggaactttattactttgtctatctgttctacagcgtttttagacattttatccccattaccagaagtattgcttccaagaagtggtacagttactccaactaattttgcttctgaccatatttttctttttgaaatatcctgatccttgtcagtaatgttttcaatggtatttttagctgcttttaacgctgctaatttggccgctaatttatcctgaaaggaattttgcaaatttaatagtttttctttaagctctgcattgcctatatcttttaaattttcttttaattcatttattttgtctttataatctttaaatttgcctccagaagaatcatttacaagagctaaaacatcctccattaatgaatctatttctttcttttcttctacatatgctttacaagccattacaaataacattgatgcaaaaaataatttaaatatgtttttatttctcattagttactcctatattcaataataatgaaataaaagctagcacaacattcgaaaaatataaatctctcaattaatatttttaaagatttttaaaaataagctctataattacaagaataaattttatttttactcaacatattgtactggagataaggaaaggaaataacaatgaaaatcatcaacatattattttgtttatttttactactactaaatagctgcaattctaatgataatgacactttaaaaaacaatgcacaacaaacaaaaagcaggggaaagcgtgatttaacccaaaaagaagcaacaccagaaaaacctaaatctaaagaagaactacttagagaaaagctatctgaagaccagaaaacacaccttgactggttaaaagaagctctgggtaatgatggagaatttgataaatttttaggatatgatgaaagcaaaataaaatctgcacttaatcatataaagagtgaacttgataagtgtactggggataattctgaacaacaaaaaagcaccttcaaacaaacagttcagggtttctttagcggcggcaatatagataattttgcaaacaatgcggttagtaactgcaacaatggtggttcctaatagctaacagccccctatttgggggctttaatattgctatgctgcaaatatataattaaattgtctttcttttttcaacatgcaaaagaattttaatacttttgttttataaacgtctcgattatcagacataaatactttaagcttatttagatcatcaaatctattagttttattgaaatatttttttaaaatatttacccaatattctatactcttaagctcagcattctttttaaaaagatcttctaaagcatcatcattatcagtacataatgcccgaataagagcatttatattatttttttcttcaccttcatttacccaattttttatattaaacagtgcgtctctaaaaatttcatagcaataagccttgccagatttcaagtttttattaaagctgtttagttgatttttttcttgatttatgtcctttttttgttcttgtttttgattaacactaacttgcttgctaggcatagaattttcgttttcgtgattattgtaaataggtgctgcatcagtatcaaattcactttttatgtcaagatacgcaactaaagcataccttttaaaataagtaatagctgcaccaacaagttgtggcattgtattcaaatttttagacccattttcaccgttccattgtaatttatctgtatgaattaatgtatcaagcgactctttgtatccagtacttttactgtaaaatgtagtcctaacaacaggaacttcaccatttttaccatacacaaaagttggaaattgccaaaaaccaagctttaaattgtgattttttataacattttgaattacttctactatgacattgaaatcttgatacttatatccgtatcctttaagacttttgtcaatacgtggcaagttcattcttaaagtatccatatcatttaaaaagtctatttctgcttgaatattattttgtatttcttgattattattgtttgaaacattgttcatgttttcctcctttatttagtaataaataagtatatagcaaaaactatttttgtcaggctttttacaaaaatttttacaaaaaagaagtgggacttaaccaaactcttttcttaaagaatctcgttaagtccccactatattattattttttgcaaattactaaataaaggtagtcaaactgaaatatgttcaaataactacgctgtttgtagtgtagcccaatttttaattaaaatcaatcaatctttttactaagttataaaaagtatattaatttaacaaaattaataattaaaatttaatatttttttagaaaagtatttacttttaaatcaaaattttgcattatattatttgtaattattaataactaaataaaggagaaaatatgaaagattttctaaataacataaaaagtctaacttgctacaacaaacaccaacacaaattaatatctcttacttcaacactagactttctaaacaaaaaagataagaaatacacgcaacaaaacatactttattattttaatgaaaatctaaaaagaaatggtctagctcccactactctaagaacaatgcaaaattatctttataaattagaaaaagtattaaaagttacaactaattactaccaacacatgggtgtaaattgtgggactgaaatttattataaactaaagtatcctaaaaaagaatgttaccagaaaatcaacaagtactttgaagagcgaaaaaactctagatttaaatctagagttaataaccattttaaagacgatatttctaaaaatggtagtgtaaattcagtggagtgtttaagtaataaaaataatataaaagaagaaagaaagattaaagaaatagaaaaatatcaagtaataaagtatttcaataaaagcaacttgttatgtaaagaaattcttccgtttttattaacattaaatgttgataaagatactatgattaaaataatcaaaaacataaaaagagttgaaaataaattgctaaaaaacacaaatttaaataaatcttgctttaaagaaaagcaagagaaactaaaaagaattttaaataacactcagaaagaattcaaacaaaatggatataaccccgaacaattaaagataaatttacaaaaagtatacgaaagttacaaatttaagccccattttattattgaaaatcataaatatagcgatttaaacaatataaagagtaaattagaaaagtcgattgaaagaaaaaaagaaaatcctcaacaaaattatcaaaatttaaaggaaaacattttcaatatccttattgaacaactaaaaaaagaaacaaatattgaaattctaaagccaattatcaaaaaatatttgaataaccaaaagaaaatagaatacaataaagtatttggtacatatcatcttgaattattagaaataataaaaaatgaaaaaaattctttaaccacagaagaatttaacataaaggccgtatgaggatttaacatggaaaatgcaccagaacctattgaagctgtaaaaaaaggcaaatgtaaagttgaatgccaaaataaagaacgctttattttaattgaaaaagaaaatggtaaagcaatgtaccatacaaaaataatgatggatatttataaatttggagtatatgagaaaaaacacgaatttagattatcattgagggccttatttaatggagaaagaattgttgaagaaactcatttatacccaattaaagaaggagataagtttattggtattttttatggctacagaaaaccaataaaaaagccattaataaagtatcaaataaacggggctagaaaagcatatgcattagcaagggcatattatatggaatttagatttaaagccggaagtgtcttttgctatttcaagggattatatcgattattagataaaaaaagaacaaataatcattacaacaaagttttatttagtatgtttacggatttagaacaacaagtgtataaattttatgggaaaaaatacccggaacaaggaccgttaataaaatggataataaaaaacctaaaataataacaatagcgtcaatcaagggcggtgttggtaaaagcacaagtgcaattatatttgcaaccttattggctcaaaaatataaggtattattaatagatatagatactcaagcatccaccactagttattattatgatgatatacaaaaatccagtatagatttaagaaaaaataatatatatgaagttttaatagaaaaattagatattaatcgatcaatcgttaatgtagcgaataatttagatttaatacctagttatttgactttacatagtataaatgcttttggttataagcacacttttgatgaatttagattaaaaaaagagcttaaacatatagatgttggatataattttattataattgatactcccccaagtttggattttactttaactaatgctttagtttgttgtaacaatgtaattgtccccttgacagcagaaaaatggacaattgaaagttttgaccttttgaaattttttatggaaaaaataggtgtagaattgcctacttattttataataacgagatttaaaaaaaataatacacataagcaattgttggaaatgctgaactccaaagaaaattttttaggaatgatatcagaaagagaagatttaaatagaagaattgctagtaattcttcttttgattttcaaatggattatataaaagagtataaaaattcattaatgaatttttatgcaaaattaaaataattataattataagttcgacgcgttgaacttataattaaggaggcttgttatgaaaaataatacaaaattaataatcaataaaagggatattgattctgaggggaatgcattacttgtagattcttctaatgttagtaaaaatggtgttgaaacagatcgttataatactttgaaaaagaaattgtatgtaaaccttagagaaggagtttctaatagagtagaatgtatgaaaatcttaaaagaaattaaagataatgaatactataaacttgatggatacaaaagtttcgatgcttttataaaggattatgatgttgcaaaaactcaagcgtataactatttaaaaattgccaatgcaatagaagcaggagttattgaggaacaatatgtattagataatggatttagattaatattaagtgtattgaaagataaagaaagtccagtattgaaaaaatctaaacaaaactcaataaaaccattgagatttcaacttaaaactcaagaaagttatgatttttacaaaagcaatgctaaatttacaagttttatgatgcaagagatttttgaaaatcaaaaagatttgattagtaaacttttaaaaatgtataaacaattaaaaggataatctatgaacaatttagcatacaaaacatataacatagaaagtataaaaaacgaatttttaaatatagggtttagcaaggaagcaatagattttgtttttctgcataatgataattacaactttgaatttttaaaagagaaaataattgatatagagaagaatttgcaaaaagacatatctaatttagatgccaaaatagacaatgtggaaaagaatttaaatttaaaaatagatggtttgaatatcaaaatagacaatgtagaaaagagcttaaatgccaaaatagatagtttagatactaagatagataatgtagagaagaatttaaatattaaaatagatagtgttaaaaatgaacttaattctaaaatagatagtttagacgccaaaatagacaatgtagaaaagagcttaaatgccaaaatagatagtttagatactaagatagataatgtagaaaaaactttgcaaaaagatatatctagcttgaatactaaaatagatagtgtagaaaaaaccttacaaaaggatatatttaacctagataataaaataaatgttttaaaaaacgaacttactgcaagtaatagaacaatacaagtaattttaataatgggaataacacttgctccaattatttattctatattcaataagtattttttaaattaagaatgattaaaattttataaagtaataagttagtatatagctttaaagtagaaattatttgaattttttaacaagagaatttaaataggttcttttattttaacaaatacaaaataattttaattctaaattgaactgaatttaatcgtttagtgagtttatctaaaataaattgagctaagcccgcggctttattaagctctttaacatgagaattgaataaagcttttatttattataataatttctgtaaaaagcctgacaaaaatagtttttgttatacatatgtatatgtatagctaaaaaaatatattgctatcaaaaaaatccaattaagttgggtttagctaagttctttaacaagagaatttaaataagcccaactatttttttgtaaaaatttttgtaaaaaagttggcaaaaatagtttttgctatatacttatttattactaaataaaggaggaaaacatgaacaatgtttcaaacaataataatccacaagacaatattcaaggagagctcaaaatgataagtattaatcaacaaagttttactggttgtgaaatatttgaggaaaaatcttctcccattaaagaaaaaagtaaattaagtaagataggtaagaaattaccaggaataagcagtcaagaatgttttagatttaatcgaaatattgattttagtgtgcaaagaaacaagttagataaatacggtgctagtgaagtaggcagtattcttgttggaggtgctgggctgaaagatttaatgataaacagagtgcttaaatattttgatatgagcctaccttttgaagagaatttatatatgctcaagggcaaagagttagagaatttaggatttagagagtttgttaaagcatacggtgataatattgatattttatataaaaataaatatgccaacggtgttgataagtataattatttcaaaaaaatgggcagttcagaaactttagtgggctcaacaattgatggctggtttattaataataatggcgatttagaactattagagattaaaagtagcgactctaattatatgagtagtgctattgctgagtacaataaaaatggcaattttttaagcagtaaatattttttcaaatattatgtacaagcacaagtgcagctagcgtgcactgggcttgagtattgtaatttgttctttttaatagatgctgcaccaattaactgtaagattaaaagagatgaggccttaatatcaaaagtgtttgaatttgttaataaatgtgaattagaaattataaatttgaaaaaagatatttatagtaactatagagaggaatacttaatggcacataattttaacgaggatacgtttataaaacttgttgaagatttagtagaaaggagtgatttttatagttctggagttgagtttgattgggcaagagaatttatagaatatgttgattgtgcagaccttgaaattaaggataatcaatctgctgaaaatcttgcgtatgatttaatggagattgatagtctacaaaaagaattaaatagaatccaaaacgaaaataaaaaaagagaaaagcccattaaagataggttgaagatgctaatttacaatattacgaatacatatccactaattgagcagttaaattataaatttggagagtttgtgtttactcttgaccctaagaaaagggcaatatcagatagattaaagggactgctgccaacaagtggtacagtatttttccctagcaatatagcatttgcaaataatgttagtgtccccatgtgaatgggtgcactaaaaaattaaaaaaataaatttaatataggaggattaattaatgcttattaataaaataaaacaagataatagaactttaagaccggagatacaaaaatggggttgttactttttgtgtctacattactatacaagtctatttaagcaacgtgaatttaatgcgtatgagataaatgcagcgtattatagatttataggacttggatatattaagagcaattgttttattataaatccatgtatgatacttaattattacggaattagaagtagcgtgagatatgaatctttaaattatttaggtgcagccaatgaatttgaaataagtgaagttaaaatcgataaggttaatggatatcactttatagcaacaaaaaataaagaaatattatatgattcacttgacttgaaacctcgtggaaaaatatttaaagtaacttcaaagcgcatatttagactaaagtagtttttttaaagtttaaggttatttttcatgcatttataagcgtgaattttgttagcagcagagagtccataaatattatcaatttcattggttgaatgatatttcataagttctttaatctggaaagagttatagccattagattttaaatttgaaataaataaatttctaaataaatgaagagatttattagcacgaaagcctgattttttaagaagaattttaaattttttagaaatattgataatgctaatttgattatctttaaatttatgtttggttttttggaaaaggtaggtacgccttgagtcgagatttttgtcattaaagtaattttcgtgagctttttgaatagcctcaaattcttcagatttgatgacaatttctctaatgcaagtgatatttctttttttagctacatttacttttatattgtagaaagtttctccagttttgcttagtagcggggtaatatcttgcattttaactttttgaatttctgcacccctgcacccacttattgcgagtagatgtagaaaccaaccagaaattgggtcagtttgttttaatgttttgacgcatttttcaattattttgctactttttgaggttaaataaaacttaggagttggttttgaagattttttagtaggcttagaagaaatttttagtgaatttttaagaattttattttcatttaccacattttgataatcttgaaatagtttgagcataaaatccatattgaaattatttaaattaaaataattattcatatctataaaatcctctccttagaagtgttacttttaaattaagtaaaagtaataaaaatttaataaaaatgtaatttatattttatcaaaaacctaaaattttagtcaaattttgggtgttctcattgcatgcgaaatttgggttgtggagtggctgtgataaacagaataggcattttttgagggtgtcggataagaaagacagtatactttatctaatatatagcaaagactttgaaatttaagttgtatggattttgtagtcttttgtaatgagtggtgcatttgcaatggagagattttggggagttggttaaaattatatttgcgttttgttaatatgtaatagctgaatgtaacaaaattatatatttaaatctttgaaaaattgtaattattcggtgttgcgttagatttaagacttatggagcaacttatgaataagaaaatgtttattatttgtgctatttttgcgctgatagtttcttgcaagaattacgcaagtggtgaagatgtaaaaaaaagtttagaacaagatttaaaaggaaaagttaagggatttttagatacaaaaaaagaagagttttttggagattttaaaaaaccagaagcaaaagttcaaccaaaggatgaagaatctatgcaagctgatgagcctcaggagcagggcgaagatcaagtggttcaaggtgttgctgaagatcaaaaattaaaagaagaaattgaacaaaaaataaaagaattaaaggataagatagagaagtcggatcctaaaagtgtttctcttaaaacatattctgattatgaaaaggaaatagaagaattaaaggaaaaactaaaagataaagaaaagtttgaaaaagaattagaaatccttgagaaagctttaaatgaaaaaatagagaaaagaaaaaaagaattagaagagtctcaaaaaaaatttgaagaacttaagggtcaagttgaatctgcaattggaataactgatggagaaagggctaaaaatcaagggaaagttggaatagaagccttgcggcatgctcggggtttgggctttaaaaatatttctagtggtaatagtactagcgatatagctaaagaaataatagtaagctcgcttaaaaagattgaagaagagcttgaagagcttaaaaagttagagaaagaatctaaagattctaataaaaaagaatagaaaaattttttttacaatcataaattataatataacaagactcacagcgagtcttgttatattatttaaaatacgtactatatttcttgtatagtttttgaaagctatcaagatcaaaagttatagaactagttaatttctcaggatcttcactttcaggaatttcaattgttattgttacggttttatgttttaataattttggcagtaaattttctatgcccggatcagaggttcttagattaatcctaatatattctgaaagcttattatatgaattattccaaatttcccacataactctattatttacaaatttttgatttaattctcttattattttttcggggccattatcaaaaaaaaatttaactttcactttactaatgtttgcacgtatatcatttaacatagggtatggattgttaaactttgctttgtaatggtattctaagttaaaacccatataagaggtttctttgccgtctttaatatcctttaaagtggtaaaactaagacgacttaattgttcatcttctcctataaagatagtagaaaaacccccttcatcagcactaagagtttgaaaaaaggatatgtgcgtatctgttttgcctttcttatgataatatttttccatatatcccttgtattgagattgatcataagaaaaacttattgttacttttaaaaataataaaaataataaaaatatttgtttttgattcatataaatgctcctttttggatatttgaaatgtttggtttttatattaataaatattgtaaatatagggcagttgttaataggtataaagaaattaataatttatgttaattgaattaacaaattgctttactatttagagtaacaatttgttaattttgttattttaggagaattttcttgaaaagagccaaaaggtcttttgatgattatgttgcatattttagagaaggattgttagatgatagggaaatagcggataaattgggggtttctagggtaaatgtgtggaggatgaggaaaaaatgggaaagtggagaaagtgttgttaaccaagactctagagtaacaattagtgaagatactttagaacaccttttatcacaaacttttaaatcagaagttaacgctaggaaagttataagtgaattagatatagagtgtgctaatttaaaattaggatttatacgtgcatttaagcaatattctagtgttgaacttactggtatgcgaactaaaatagaaaatttaagagccgaaattgatgctttaaataaagcaagtagtaaaaaaaacaagcaagttgttaatggagaaattaattctttaaaaagcgagcttgatgaatatataaaggagtgttcaataagagaaatggagctttactatgaatgtatgaaaaaacttacaactgctaatgaggctgaaagcaaaagcaactacaaaaatagtaaagggcacaagtgaacttatatcaaacaaaactttttacaacactacaaaaggaatacaaaaataaatatggagttgatatatcacaatttgtaaagctaacaaattcttcaattaattttgataagtttgaagaaaaacagttaactttaaaacaaaaaaatgtgataaaaagtattaaaaagaataatgaaaaaaagattatactcagcggcggcatagctagcggcaaaacgtatcttgcatgctatctttttctcaaaagtttaattgaaaataaaaagttatattctagcgatacgaataattttattattgggaattcacaacgctcagttgaagttaatgttttgggacaatttgaaaagctatgtaaacttcttaaaattccttatattccaagacatacaaataattcatatattctgattgattcactacgtattaatctatatggtggagataaggcaagtgattttgaaagatttaggggaagtaattcggcacttatttttgttaatgaggctacaactttacacaagcaaactttagaggaggtcttaaaaagactaagatgcgggcaagaaactattatttttgatactaatcccgatcatccagaacactattttaaaaccgattatattgataatatagcgacctttaagacatataattttacaacttatgataatgtgctacttagtaaaggatttgtcgaaacacaagaaaagctatataaagatataccatcatataaagcaagagttttgctaggtgagtggatagcaagcactgattcaatttttacacaaataaatattactgatgattatgtatttactagcccgatagcatatttagacccagcatttagtgttggcggggataacactgcattatgtgttatggagcgagttgatgataagtattatgcttttgtatttcaagaccaaagaccagctaatgatccttatattatgaatatggtaaagactgttatagaaaatttcaatgtgcatacactgtatttagaggatagagataatacaaaaggtgctggtggattgacccgtgaatacatcttgctaagaagtaatataagccaatattttagaattgttccagttaagccaaagtctaataaatttagcagaataacaacgttaattacgccgtttacttacaaaaaactttacattacaaagtacagtagttcttctgtatttaatgatatttattcgtataagggggatagcaaaacccatgatgatgctcttgatgcaatgtctgcagcatatttgatgttgtctttaggatatagagagcgaagtgttcactttggcaatcaaagatttttgtaa

SEQ ID NO: 209 - DNA, 30651 bp, Borrelia burgdorferi
attttattgacaaaaatattagtttttgctatcatacatctaatttaataaagagaagtaaaaaggtgtgtgatttaagaaaaacaaaactaatagataaaataagttcactagaactatacaaatactcaatattttttagaaattacattgaaaatgtagcagaagattgcctcaagaatggacttgttcttgagagtgctgaccacaatgttagtgaggttgaacttgctaggttaaaggtacagcttaagaatgctctgcttaattgtattataagctaccgttttcatgggattggctatgttttagtaaaaaccaaagatactctaatagatctcgaacaacccgttaatatagaattacccattggttttgaataccttgattatgaatatgtaagagatttgggagttgattttgatcatataacctataaagtaaaatccaacaataagaacaattctttagacgcagttaaaatacataaaagtcgacttatcatatatgaaaactttgattatatcttaaaaagatatgttccgtgttataccgaaagctttttactagatatttatttatttgaaaagatatacgtagaaatagaaagacgtattgaaaaccacaattttttgttttacaaagatgaatctttagtacaactacaagacgcgctttctagtgcaacaacttctttaagtgcacttactaagagcagcaataatgatgggggaagtggcattttatcttcttttttgagaaaacaaaattcaaacaatcatagtaaagatatttctaatttaagaaaccttaatgactcattatcacaggagcttgctaggctaaaaagcaatctaaataatgagggaatgttttatacggccacccttagtgctagtttagaggttattaaatacgatcttagttacttaagggaggctttagcattaattaaggcaaaaattggtgcagatactaaagagcccttaaccagaagctttaatgaacaggctaaaggattaggaaatggtggtaaaggtgataggagtaattattacgattttctcaaaggtgtgcaagaacaaattgagaactcttgtaatttaaaacttacaaagtattttgggcttgatatgaaatttaattcgctgattatgttaagtgaagaacaaaaagtggaaagagatataaagctaattgagctttacagtaaatataaccagcttatacaaagtagctcctttgataatgaggagttagcgattttaaaagagaaattattctcattttgagaaaaggagttaaaagatgactgagaaagaagaaaaagaagacctgcaagcacaagataaagaagagcagcaaaataaggctgatactaaagttataagtgcgcaggaatttgaagagtacatgcgctttaaagagcaagcaaatagtaaatccaaagagacaagtcgagatttaagtataaatgaacgaataacaaaagaactcgcagaagttgaagagagggagcgtattaaaaagcaattattgctagaggctgagcgcataaatgaaattgatacacttgcaaaagcacatcttagcaatcatttcaataaggaggtgttgcttgcaaaaggatacacattaaaagacattatgcaagcacaacgtagagaacttgtgcgcaagttcgttccaattgagcaaattaaagctattgccaaagtatcagacataagtcatatcgatggagagatgttagagcaacttgtttctttagcaaaagtgaatattaaattaagaaaaactgcgagtagcaatttttcttctgttgactctgtcagaggcaatattgttgttaaatcagaagagagagcaagtttgcttgattctaattttgtacctattaatttcacagaatttgtacaagcgataagtaatacttacaagcaaagacgaattcaattttatgaaaatctaaaaagacataaaagaacaagtattgcttaaaggagtttttaatgagcgatggtattacaaaaataaaagaagagtttgataaaaaagttgcagaaattaaagcattaatgaaaaatcctcagcaagatgctggtttgcttaggaattctgtagactttagagataaaaatctaatttactccaattcggatggagtttttactagtagtaaagacaaaatagaaaattatcctgctaaagggtatccatacaagcgtggagtcaagcttagttttagtgcagatggtacaacagaactagaagttgaggctggtggtggggatgacttgtacggaatatgcactgatatagatgagtttactggcatggcaactgtagttccaattataaataacttcacggggtatttaacatttaagaaaaatggacaaaatggtgtgaatccgggtgataagctgcattttaatgcacaaggagagcttgaaaagaatgggggaaatgataaatctgttaatgctatagcactttcaaaagtacataaattaaccgaagagttatccatagtgcttgctagtgtttttgggaatagagctttaaaaggtaattaaattatggctttaaaaggcaaagggcaagctaaatctcctaatgttcatgataatccacaattagggttagaatcagaaattccagttgctcctagatctaaacgtcaagcaagacaggctgaagaagcacaagcaaaagatccttatttagattcagttaaagaacttgacgatgttcttttaaaatttaaaaaatattcaaaatcaatgagttcgattgaaaataaggtttttagtagttcgggtggttgttttaaatcaaagaatgagcgagttaatgcttattcttttacatattcaagctttgcagacaaaatagaagaatacctttatgatccagcaaatagttttccatataagcgtggggttaaacttgttccaaaagagaattctatatatgttgaagttggtgctgatactgatatgtatgggatatgtgtagatgtatgtgagtttagtagtactgcgtatgtattaccaattacgaataactttgaagggtatcttgttacaagaaatccgagtataaaaatgggagaaatattggatataaataacaatggggttattatcaaggctggtggtgggccaccaaccgcaattaatgcatatgccctctctgattcatttacaatcaattttgcacccgaagatgaacatcaagatcaagctagatatcccaaacaagagtattctattaatttgataaaagttgcaatttttggcaatagaggccttgagaaaacagtaacacctgaagctggtggttaagccttgggcaataaaaggagttaaacaaatggcagacacaacgcaattattaaaagattatcaagataaacgaagtaaacttgaaaagtttatgaaaaatccccagtatgacgctggtttgcttagcaattctgtagagtttagagataaaaacatacaattttttgcctctggaggcactagaaccagcaaatttgacaaattagaaaatcatccatttttaggatatccatataagcgtggggtaaaaagagttattcaagaggaacaagagaatcaaattcactatgaaccccacgttgaggctggtggtggggatgacttgtacggaatatgcactgatatagatgagtttagcaaaacagccactattgttccaattacaaataattttgagggttatttagtagcaaaagattctacgcttaaagtaaaagacaaacttgttttaataaagacggtgctcttgaaaaggtgactggagcaccaccaaataaggcaactattaatgcaatagcgttgtctgatgcaaaacaaattagtaacgatgtttatttaataaaagtagcagtatttggaaataaagctgtaagtaaaaattaatgatatttgggaggatttaatatggaattatttgatgaaaattattatgcaaaagctgtggctaatattataggggaagttaaagatcctataatgtataaatggttttcgcctgatcaaattgaagatgttgatcttcagatgggctaccaaagaactgtaaagtgggatgcgtttttaaatgctaatcctacaacgattgctaatgaggttaatactatttcaactattggatttagttctgaagtggtaagacttaattacttaaaattacagtacaaatttaggcacttaaagcaggcgtctgaaaaattttacacttcagactcatatcttggtgacattaataacaatttacttcctttctctcaagcctataagcttgcaagtagcgagattattaaacttattaatcactttgtactaacaggcactgtttcaattcaaaaagatggaaaaaatcaaaaacgtctacttcccaatatgtatggacttcttaatatgccacatcaatcaagtaaaagaagaggttgaaagtgctaataaggacaaaatggataaaatatttgaaaaaattgaggcgggactttcaaagttagagctaggagacgaattttctacacctatgatggtaatagttgaccctacaacttctctcaaactcgtaaagccatacgcagcagcacagggtgcagcaagtagctgcgaaaaatgggaggatgttttgattcaaactatcaaggctattaataatagagaagatgtctacattgaaacttcaaacttgctaaaacatcaaatacttatttacccattaaacccagagcttattaagtttaaacctagcaagtatatgttacctacaccaaatgaacaagtggataaagattcaactgatattgctcattcatacattgattttgttttaggagggctacttgctactagaaaaactattttgcaagtacatattaaacaaagttaaaaacataaggtaaatcgaagtgagcgaacaaaaaaacttacaaacacaagttgaggctgaagaagaacttttggtaacaaaacttcattccgaagtgttattgttactaggaatagacaaacttgcattaagcagacaaaattttctacttcatttatctttacttcaagctattctagtaacacgtggtattgatgctagttcacttacatatgaacaaatatttttacttaccttttaccatatgggttgtcaattaagaaaacagggagttgttcgagaatttgaatttgataggatcaaaaaagagaaattcaatgaacttgaacttgattattatcctagtagcagtggaggcgaagaaggtggcgaggggggttgtggctcaaacaagagtttttgttcacaacctgatgcatttttagaaaaactaaaaagagaaacttcaacgccatcttgtgtgggggttgtctaatgaatggtgttaggaaaagactttctgatatgtcatttcgcatgatcaacgtatttaaggatcctaaacccttaaagttttataaaggtactgttgtaaagcttgaaaatgattcttcttatcagagagtatttgataaaaataagtacactgaattcgcaggagttattattgacataaagccacaagaacttgcaattctttatgattctgatatgtctgatattcaaggatattccaaactttacacatatcaagaccttaactatgaactaaaagaccgaatatcaattgcagatttagtttactttgaaatatttagtattgactcttcaatcggatattttactttggttttaaaggaatttatatggacaaactagaatttaaaatggaattggaaattgggtggtttggtggtcgtgcaggtattgctaaaatgcatgaaaaagggagtagcaatttaccagcaagaaaacatttaaccaaaattgctagtagttctgagtttagagaatatatcaataatagctatataaattctaagtttaatcttgaccctaaatcaggaatggaggctattggacaagcttttataaggtactatgaaaattatctactatcagcacaagtcactccagccttaaaggctaatacaatcaaaagtaagtttaaaaggggcagtaacactgcagcaattccacttgttgatacagccaaaatgttatcagagattacttataaggtaacacttgaatgattttcactttagatatggtattaaatcatttaactcaaatatttaaagggtttaaggcgtatgcaactgaaaataattttgagtgcgatatcataaatacctacaatcatccatatctttcaaaaatcacagctgctagctcaaatataatagcattgaaatttgatggtacagaaaatctatttgatcataattataaagccggtgtattttatgaaaatgctttggaatttagtataaattttcaaatatatattattgcaatagtgttaaacgccaaagactttgacgctaattcacgcatgttaatgctttatagtatgcttagtgactttctacacaataaagctcataagtatactttgcccagtctacaacccgaatatattaataaaattaacttctacatttacccaacatctaatatgcaaacagttggactgattaatttaggcacaaaatatagcaaccatgcatacagtgcatctatagcattcaatgctagtgtaaaagcaatcgaaattttaaaggaggaatacgaaattgccgcaagatacaattagtgtaagttttattgactctaggattcagactagtaggcccaattattataatccacttttggtttacaaaacagctaaaatcaaagttaacaaagatgctgctagctataaaatattgaatttaaccgttaataattatgaaaaacaaattgaaactttagaaaaagagaatggaaatgaagaagatcagtttggaaaagaaaaaacactgcttaaaactgcaatgtcaaattttttcaattcaagcgaagaatcgttaaaatcagccgatcttttcatttataaggataagcctgaagagctaaaaaattatcttaaagtacatagacacacttttgttgtacttattaacactgagggggatgcgtcagatgatggacttaaaatttacaaagatgactataataaattcaaaatgccttcaactttttttgtattctcgactaaagaacaagaaataaaagaactatttaaagataaaggcaatactgaaaaagaaagaaatattgctgtttacagtaacaataaagacaatttacaccttaaatttataagtcaatatctccatcaagctagtatttttcatgctgtaaatccttatagcatgccgctggctgctacaccacttgttgatgatactgtaattggaaagttgcgaactgcaaaaatcaacttttattcacttcttaatgaaactgggcttgatggtttacctgcctttaaagaaggtgttgacctagctggaagtacaatagacgaacaatttacataccactatataaaaaacgaagcgattattgagcttattaaaatttggaacaaaaacaataggcaaaatagcaaattatctgcactgcagcttagtggagctagagacaatgcatatacttcagcaattgaatgtttactgaaaaggtttgtggatagaggactgattattgagtacaaaaatttaaatcttactctttctcctaccccgcaacttaaattagaacttggcgtgaatattacttataactttagcattaatgctgttgctttagtaattactactcaagatatagtttgattatcaaaacagcttaagtgcttaaaagggggtctaaaaatgcaattttatgatttaagagaagtttatttttcaattggtggtacgcagttacatagtggcaagctagagcttacaagcgaacctacaacaagagcagtgattagtagtgaagataaaggtatgcctgtaataagcttaagagatcccaaaacaataacttatgttttcaacattgaagtgacactaggtagtcatgactacattttgttaactgaactttctgatgaacagttttacaacatggatgtgagaaaagaggataaaatgcttgatttagtattcaatgatagaattgctaccaaaattatttctaactatgcaatttttactgaagagccttcaagaagttattctgctgaggccgaaaaagtatcttttgaaattagggctattaattgccaaaaaactaaaccaaacaacacttaaaaggagagtcttattatgataatgagatataaaatgaaaattttaactaaaaataaaacttatgaatatccactaaaagtattaccagtctatgaatgggataaaggtgctaggatttaatcaaagtgacgctgttttaaagcttaatgaggttaaatacttaagagaaatcacaagcttaatgataagtccaaaatttttagacgaattatatgtgattttggatcaaaatagagaatttatttcttattataaggactatcttgttgcaataatttacactgcacaatttaatacttttcatttagacaatgatctaaaaaagcccgctttagtatatttgagtgagtatgaaaataatgttggtgattttgttgcttttgactatattaatgaaaattttgattatgaaaaagtagccacttcgctttcatcaattacatcaaattccaatgcgctggttgctaaatgagcaaaagaaatagagatattgataaagctattgcaagtcttgatgagactagaaaaaaatattttaacttgcttgacgagattaagaacgataaatactttttcccagtaattatgaatatttgctcatactactcggttaaaaaattgccttatgacgagcttttagaagtcaatagacttgctgagattaaattagaaaaagaattgtatgaattaattttaagcaagtgaggacttagtgggcgacaaattcaccattaaatttaaaggtattcttgatcatgctgcaacaaaaaaggccattgaacaagatatttctaaaatgggaaaatatcttaaacctaaaaaatctagtttgggtagcactaaagatattgtaaaaaataatttgtcggacaagaaaaaagaacttagtagacaatctaaatttgaaagcttaagagagcgtgttgagaaatatagacttacacaaactaaaaaacttataaaacagggcatggggtttgagaaagctagaaaagaggctttcagaagatctttaatgtctgatagagacaaaaggcgtcttgagtataaagaacttgcaaaagaatcaaaagcaaaaagtaaaatgttagcggcctctcaaggaaaaggacttgttgccaaaattgctataggtagtgccctagggaatatcattagcaacgctatgagtaaagttggaggaggccttttaggttttgctaaaaaatcggttgaagaagacaccaaaacaaaaagaacacaacttctcaataaagcgttttatggtgatccaaaagagaaagagagtcttttaaagattattggcggaatgaagggatttgagcgcgacctagaaaaagaagaattcttaaatcaagcaagtgtctttaagggtactttaagggacttagatatgttaaatgaaactaatttgaaaaacgcagtagaatttgcagctatgcttaaatccagtggtgctatgagcagcgaagatgcagtaaaggctgttaatagtgttcttgggggtgatggaagtgagctttttgatctactaaaaaagtcgggcgttggcgacaaatacatagaagatgccaaaagggcttggcaaggcggggctgaggtagatttagagtccagaattaccaagatgatggaaatgttcgaggattttaaatctttcggccttacaaaaaaagccaatactgctgagattattcaaagtaatttggcctcagctgagcaaactcttcaaaacttaaccactactgtcttggacccattacttgacctcattaataagataactaattactttaaagactttacgtttgaaacacatattattgaacccataattaatggcattaaaagtatttttaatcttaattatttctttgcaaaattaaaatcgatgctacctggatggatgggcggagatgagggtgcggctctaaaaaaactacaagaagaaattcaaaatcaagacaatgctaacagcacaccataatttttacaaaaggtaattacttatgacaagtaacaaaaaaattgctaacaatgcagctaacaaaatagatattaataataaaattactaacaatcatgatattgaaaagaaaaaaatcgaggaaaaaattaatgatattgaaaagaaaaaaatcgaggaaaaaattaatgatattgaaaagaaaaaatcgaggaaaaaattaatgatattgaaaagaaagaaatcggggaaattactcgaataataagagatgtaataacccaaatatttgcccttttcggagcagataattttttagtgttatttcctagaatggatctaaaaggttttggatatgttcctcaattgttttttataaaaccaaaaaatgaactcataacacgcacttacaatactaattgttctaaaagaccagttatcaactattatgatagaaaagcggaatatgtaagctacaatccggtaatgactggtgaaaacatatcattaaacggtggaatactaacatccttatataaggatatgctttctttacttaaaatgactgtttttggcaatactatgctacgttttgacgcgcatctcgcaaaagaacaactagcaaacagacttcaagctcaagttccttttagtatctacagtccaacttttggcctaaaagaattggctgtaattacaagtctttcgtttaaggacactcctttcattgacgaagttgaggttagtctatcaatagaaatagtaaaaacatttgcattggaaaaatataaaggataaaaaatgctgttactacaatatgattttaaaattgagttctacaatgtagatacatcaaaaaaatcccctgatggaattcctttcgccgaagaaattcctaaaattatcatcaatacacaagatggaattcatattgatatttccatatccaacgtgtattcaaatattcatactataagttccaaacaagcaaaagtcgtactttggaatcttcccttagacctcaccgacgacattaaatttggagatatagtaaaaatatattataagaaatttgctcatgaaaaaaattttgatttcataatggcaggaactttaggacctcctatgagcactgattatccgggtggggattttagtgtagatcttgatgttcgtttattaactaaaagcaatttcttcaatcgcgaattggcaggcaaagaaggcaaaaactttaaaggcaaaacggtgcaggaggcaatagaatctgtatttcccaatcgcaatatccttaatatggatgaaaaagattgtcttaaaattattgacaaagatatttatgccacaacaccaaaagagtttattgacaaaataaaaggaacatacgctcataacgtaatagccgatattggtactggtttacggggatatgaatgctatctgatatttactaattatataaaaaagggggaaaatgtccactacgaggcattagaagactatgggcttgaatttataccacaacaagaaattactttgggcacaacactcaaaaaaaatcttatattttggaacgcaaaaacatttttcacacataagttaaatgttggagataaagtctcatttattgatggactagggaaaatgataaaaaccactataaaagaaacaagtgcaaggcttagcaatacaggagagtgttcattaatattaaagttagaagatgattctaatacaaaacgtaaaaaataaaggggactagaattagaatgaatgaagactatgaaatttacagaatgaatcaacgcctttatggccaggcattggctcaagaagaccttaaaaattggatttattcaaacatttttataattaaaattggcactgtaaaggggtttaaacatcaaacttaagaagctattgttacaatacccgaatttgaagatttagaaattcacacaaaaaatatttctaatatccgtttagaactatcaaaaggtgataacgttttactgcttcaatcaagcgttaatatttttgataaaaataacgatattcactttgacaaacatcacttttatatacttagtgcaattagcccaaagactttaaatctaatctctgatactgttaaaattaaagcaaacaataatattgaaatagctaaccaaacaactagcttaaaaacaattctcaaaaatattgtaagtgctattgagggtataaaaatagcaaccacacaaggaggcccagtaattgaaccagtcagcctaaaaatagcaaccactaaaattaattatgatattaacagtttgttcaagtaatttttgctaattatggtataattaatagtatggatttaagattaggcaataattttgaattggtatttaataacgatttatcacttgttgatggaattgaagaacaaaaacaaagatttttgatatttttaaaaaccttaaggggtagtttaagctatgctcctcattggggattggactatttcttgcttttaaaactgttaaaaattaacaatcttcacgctgtaaaaaattattttcatgaaatatctaaagagcttaacttagatttaataaatatttcaactactatacaagacaataaagcgcatatatccttttttttctcaggcgatgttttgaatatggagtttaatttatgagcatcgtttttgattctgattttggcattttaaaacgtacaattaaggatattgtaagatcgaaaagagaatatttgcgtgtaaattatgggattaatattgatgataatcaaagctcaatttataacattattgcgtcttctttagcattaattgaagaagaaataattaatgagcttaatctctttttttctaaaatgaaaccgggtggcacttattgggctgctattgaagaacacatttcttccaaaagcacaacttacagcgcggttcgcacggctttacttaatcttgatgaggttgagtacactaatattaaaagtgcagctggtaaagccaacatatatctaattctaaaggaaactttactagacactagtaaatctaacattaatagttctgaatttaaagcaaaactttgggaaacattatatctaacaactcctagtggtactttacttgagggagacatagaaattgatggtctcaattcaactggacaacgtaaatcctataaaatatcactagggaaaagaaaatatgtttatatgaaagtaaagtataaacttgaccttaaaaactatctctacttaaacatagactctcaaattagggacatttattctaggattattttaaataactattctgatatgggaattagctttgaatatcaagacttttttgctccagttaatgaagttaaaggaattaagtttatggaaataagtgcttgtattaaagatacagacactgagagtattacaaaaattggtgatagcgattttaaaaaaaatcaagatattgccattaatgatgacacaatgctacttttcaatacgacagatagattgcttattgatattggatagttaacaaatatgaaaatacccaatcttttcaaaaacaccgaaattcataaatttatacgtacagaaacagaatatgcacaagcattgcttaatgaacttaagtcccttaattccaacttcatgtccattaatgtaatagaaaatataaaatcaagatatattgcaatatggatatctcaagttttatctatcttttatgcaaaaactcaaactttacaaagtattacaagcaatattaatagtgttatttttgctttacgtcatattggcactgatgagtcatttagactgattttcaagacctttttaaatgtggatattgaagttactactcctgaagctggggttattgatatctctttaaaaggggtaataaaaacaaactttactacatttatttcgcctagcactaagaaaggaaaacgactaaaaaaagataattcttagagaaaagaagccgggatacgctgcatctaaaaaagctttagtatttaactcacttcctaaaggctatgatcattcaatttatgcttttataaagagaattattcctattggtagagttctcaaaattaataatacagatggtaacaatattataacttttaacaactaaggaggttttatggctgatgatcaagaaaaattactaattgatgaagaagaaacggttcaaataaaagatttaaataaggttacgaccgttaacaatactgatcttttactgcttgatgatggagctgcaagcagtaatgctatcacctttaaaaactttttagatgcttctaaagacaaaatatttaaaggagaaggattagactattttaagcagataattaagtctacaattgccgaagaacttgcagccaatacagattttgtagaaacaatttatgctaaaataacggacaaattaattaacaacgattctactaatatttctaacctttttagtaaaattaaatcacgccttacaaatagcatatcatcagccactctatctagaaatgatgatcttttgataatgtcttcttcaagtattcaaaaaacacccgttccaaaacaactgcttggagcaccatcagatttttcacatggaagaaattttgcatacggaccaacgctttattcgtctgactacaagaacaaatcaataactattaagttggagcacactaataatgcaactcttattttttataaatataaggataatgaccccatttaccttgatattgagcttgacgcagaacactacagtaatagcgagagtaaagtactttatctaagatattccgatgaaagtgaaacaagtatggcttatgagcaatcagacgctcccccaaggactatctagtagatttcccatgtataaaggatggtatattcaaaaaagagcctacctatcagggggccccatcccgcagctttaaaagctgcaaacttttttagcaaaaattacgattttgatataatgtatatacaaataaaaaattaaaataaaggattaaaaaatggatactattaaattaacagaacttcttatcaatttaaatgaaattaaacttatagccgtaatgatttttgtaacagtattggttttaggagtgttaattcttctcaagcctttattaaaagacatattgactattgtaataggcaagatttttaagaatggcaatggtaatggcaaaaatcacattaaaaaaagagattaacttatgaaattatccaaagataatgttgagcttggacttacgtctttatcaacccttattgatatattttctaaatttgaagatgaatttgatgaaattgcacataaaggattctttttggtttatgagctgtattctcattataaattaatctatacagcaaatatggaaagacttgagagtgcattaaccccagcaataaatgcggcactcgctccattaaatgaaaaaatcaatcaatgcattgacttagttaattctgatgaaaaaaatctcaaaatatctaatgatctgaaattcaatcaggaaggaaaacctatctataaggaaagaacaaataatgcaaaataacactattggtttaggacttaatttactatccagcttaactaacatagctaaaactgatacaaacatagatcataattacattaatacttttagtaaagtaatagattttttctacaaaacatatataagcacactaaaatctatggaaacagctgagtcaactaaaatatttgaagaaatacaagacattttaaaatataacattgagataatagaggctatctctactgataaaagcaaaagaattatcacttcacttaaagcaacacgtaacaaaatcatgaaagaatatatcaaaatacttaaaagaggtgaaaatgcttaaaagattgcattgtctactaattgctttgctactatgttgcaccactattgccaacctaccagaagagccaaacccgccaattattccaacactaaaatctttagctaaatatgaaacacaactttcagagtatgttatttacctagtaacatttttagctaaaacaaaagttaaagttaatgatccaaattatccagaatatccttatccagacttatcagcactaaaagacgaacactccataactgcggtaagacataatatcaacatatatttagagtacattaaaaaaacaaaaccaatagcggaaaaagtctataataaatattcccagttaaaaatgtaaattacaaaaaggtttttcttgcaagaaattctattttacatataaaaatctctaaagccaattaatctaaaatagtgtataatatgaccataagggaaaattttatggaaacagtgtcaacaaatattgcaagtgtaactcaagaacaaatatataaagaatttattagactgggcatggaacaattaatagcacaagatttatctaaaagatattatcacaatgagctaacatatagagatttagaaaatttagaaaaacaatttgatataaaatttgataatcttatttctaaaatagatagtgtcaaaagcgaacttaatactaaaatagacaatgtagaaaagaatttaaatctaaaaatagatggtttagatactaagatagatactgtagaaaagaatttaaatctaaaaatagatggtttagatactaagatagatactgtagaaaagaatttaaatgtcaaaatagatagtgttaaaagcgaacttaatgctaagatcgatagtgttaaaaatgaacttactgctaaaatagacaatgtagaaaagaatttaatgtctctttcagaaatgcttaaatgggtattgggaattatgggagcaatgtctatcacaatgatagcagggctaatatttgctttcatttctaaatagctactacctcacttaaaacatatcaattcaaataataattgtttatccaatatttagtattaataattgattaagtgaatattaataataaaaaaaggaataacaatgaaaattatcaacatattattttgtttatttttactaatgctaaacagctgtaattctaatgatactaatactagccaaacaaaaagtagacaaaaacgtgatttaacccaaaaagaagcaacacaagaaaaaccaaaatctaaagaagacctgcttagagaaaagctatctgaagaccaaaaaacacatcttgactggttaaaaaccgctttaactggtgctggagaatttgataaatttttaggatatgacgaagacaaaataaaaggtgcacttaatcatataaagagtgaacttgataagtgtactggggataattctgaacaacaaaaaagcaccttcaaagaggtggttaagggggctcttggtggcggtatagatagttttgcaactagtgcaagtagtacctgccaagctcagcaataatatcgcagcccccatgtgggggcttcaccatataagaattcgctatgctgcaaatatgcaatcaaaccgttcatattcttttaagacactaaagaatattaatggactagggccataagcagtcctcttaaacgacacaaacttttcaaaatcttgtaaatcctttaatctattatttttcttgaaatagttttttataatctccgcccaatagtttatacttttaaaatcactatttttctcaaaatacgagattaaatcagattcaattttcttgatatcatcaacattattggggtctatattctgaataaagcttattttttgaataattgagtttatattatcttttgttgtagggctatttacccaatcttttatattagacaacgcttctttaaaaacactgtaataataaaacctatcttttttttattcttgcttaatatctcttttctggttttgaataatattatttttctgaatttgattaatctcttgtttttgttctcttttttgttcttacttttgattaacactaacttgtttgttaggcatagaatttctgttttcataattattgtaaataggtgctgcatcagtatccatttcgctttttatattaagacatgcaactaaagcgtatcttttgaaataagtaatagctgaaccaacaaattgtggcaatgtatttacatttttagaaccattttcactgttccattgcaaattttctgtaagaattggggtatcaaatgactctctatacccactgcttgtgctgtagaatgtggtcctaataacatgaactataccatatggatcatgtgtaaaagttggaaattgcctaaacataagatccaaattatgcttttcaataacgttttcaatttcttctaatatgtcattgaaatcctgatacttatatccgtaccctttaagacttttgtcaatacgtggcaagttcttcattagggttttcatatcatttaagaatttaatttctgcttgaatattttcttgtggattattattgttttaaagattttccatctttttcctccgtttatatgtattaataaatataagtatatagcaaaaactatttttgccaacttctttacaaaaaatttttacaaaaagtgcgggcttagctaaattctcttgttaaagaacttagttaagcccatatctttatttcttgtaaattcatataaacggtagaaaaaatgcgaacattttactacgctatttgtagtataagtcaacttagaattaaaatcaatttatatttttactaaattacaaatttttatattaatttaacaaaattaataattaaaatttaatatttttttagaaaagtatttacttttaaatcaaaattttgcactatattagtaattactaatacatgtaaacggagaaaaaaaatgcaaaatttcccaaataaaacaaaaattccaacttgccacaacaaacaccaacacaaattaatatctcttacttcaacgctagattttctaaacaaaaaagataaaaaatacacacaacaaaacatactctactgctttaacgaaaatctaaaaagaaatgggctagctcccactacactaagaacaatgcaaaattatctttacaaattagaaaaagtactaaaagttacaactaattactaccaacacatgggtgtaaattgtggaactgaaatttactataaactaaagtatcccaaaaaagaatgttaccagaaaatcaacaagtactttaaagaacgaaaaaactctagatttaaatctagagttaataaccattttaaagacaatgtttctaaaaatagtagtgtaaattcagtggagtgtttaaataataaaaataataatacaaaagaagaaagaaagattaaagaaatagaaaaatatcaactaagaaattatttcaataattgtaactttaaaacggaagaagctctttctattttgtatttaaatattgataaagatactaagattgaggcaataaatatcttaaaacaaaatgaaattgccctaataaaaaaattcaatataaaaaaatcttgcatgaaagaaaaacaaaaaaaattaaaagaaattctacacaacactaggaaaaaattagaagaaaacgggtacaatcccaaacaattagaaataaatttacaaaaagtatacgaaaattacaaatataagccccactttattattgaaaatcataaatatagcgatttaaacaatataaagcgtaaattagaaaagtcgattgaaagaaaaaaagaaaattctcaacaaaattatcaaaatttaaaggaaaatattttcaatatccttattgaacaactaaaaaaagaaacaaatattgaaattctaaagccaattaccaaaaaatatttgaataaccaaaagaaaatagaatacaataaagtatttggtacatattatcttgaattattggaaataataagaaaacaaaaaaattctttaaccacagaagaatttaacataaaggctatatgaggatttaaatatggaaagtgcaatggagcctattgaaactataaaaaagggcaaatgtaaagttgaatgtcaaaataaagaacgctttattttaattgaaaaagaaaatggtaaagcaatgtaccatacaaaaataatgatggacatttacaaatttggagtatatgaaaaaaaacatgaatttagactatcattaagggccctatttaatggggaaagaattgttgaagaaactcacttatacccaattaaagaaggagataagtttattggtattttttatggctatagaaaaccaatcaaaaaacctttaataaagtataaaataaatggaactagaaaagcatatgcattagcaagagcatattatatggaatttagatttaaagccggaagtgttttttgctattttaaggggctatatcgtttattggataaaaaaagaacaaataatcattacaacaaagttttatttagtatgtttgcagatttagaacaacaagtatataaattttatgggaaaaaatacccggagcaaggaccgttaataaaatggataataaaaaacctaaaataataacaatagcgtcaatcaagggcggtgttggtaaaagcacaagtgccttattttatggcaatattttagctaaagaaagacataaagtattgataattgatagtgatccacaggccagtattactagttactttttgtttaaattaaaagaacaaaatgtgaatgtcgaaaattacaatctttatgaagtttttaaacaaagaaaatatatagaaaattgcatttttacagtatctaattgtttagatataattcccagttccttagaattatctgtttttaattcagaaagcataccattacaagacaaccttttagaaaaaagacttttgactattaaatctaaatatgattatgtgataatcgatacaaatcccagcttaggacatcttttaaacaatgctttagtaattaccaattatttaataataccaattaattccgatttatgggcagttgaaagtatagatctaatattagatgcaataaataaagtttatagaaatgatattacaccttattttttagtgacgggggcactagagagacaaaacatagataaggaaataatatttaatttggagaatagatataaagaaaatctaataggagttattcctaaaagagatgatatcaaaaaagtgctgttttatagaaaagaattttcttcaaaaacagactattatcaagaatataaaaaatctttagataaaatgttaaaaataaaataacaaataaaatatatccagtaatggacaaataaggagtttgcatgagcattaaaaataaaatgataataaccaaaagaatagatataaaggaaaatatgtctaaaatggagtcattagaagaaattcataaagaagaatatttgagattaaaagacaaattaaaaactctaacaacggatgatatttataataaaatagaaacagcaaaaatattaaatgcgattaatcaaaaaaaactgtatattttagacggatataaaaatttttatagctttttagctgattttaaaatcgctaaatctcaagcatataaatatataaaaatagtatcgggcgtagaaaaaggtattattgactataattttattgctaataatggcattgaaaaaacaattaaacaattggaaagtaacaatgttattaaaaaatctaggcaaaatccaataaagcctttaaggtttcaacttaaaaagcaagaaagttatgatttttataaaaaaaatgggaagtttactgggtttttattggaagaacttcttgaaagtcaaacagatttgattaataagcttttaaaaaaatataaacaattaaaaggatattaagaggattttatgagaaatttggtgcacagaacatatgatatagaaagcataaaaaatgaatttttaaacataggatttagtgaagaggcaatagattttgtttttcttcataatgataattacaactatgaggttttaaaagagaaaataattgatgtagaaaagaatttgcaaaaagacatatctagtttagatactaagatagataatgtagaaaagaatttaaatgttaagatagataatgtagagaagaatttaaatattaaaatagatagtgttaaaaatgaacttaattctaaaatagatagtttagatactaagatagataatgtagaaaaaactttgcaaaaagatatatctagcttgaatactaaaatagatagtgtagaaaaaaccttacaaaaggatatatttagcctagataataaaataaatgttttaaaaaacgaacttactgcaagtaatagaacaatacaagtaattttaataatgggaataacgcttgctccaattatttattctatattcaataagcattttttaaattaagaatgattaaaattttataaagtaataagttagtatatagctttaaagtagaacttatttgaattttttaacaagagaatttaaataggttcttttattttaacaaatacaaaataattttaattctaaattgaactgaatttaattgtttagtgagtttatctaaaataaattgagctaagccagcggctttcttaagctctttaacatgagaatttaataaagcttttatttattataataatttctgtaaaaagcctgacaaaaataatttttgttatacatatgtatatgtatagctaaaaaaatatattgctatcaaaaaaatccaattaagttgggtttagctaagttctttaacaagagaatttaaataagtccaactatttttttgtaaaaatttttgtaaaaaagttgtcaaaaatagtttttgctatgtaattatttattacaaaataaggaggaaaaagatggaaaatctttcaaacaataataatccacaagaaaatattcaaggagagctcaaaatgataagtattaatcaacaaagttttactggttgtgaaatatttgaggaaaaatcttctcccattaaagaaaaaagtaaattaagtaagataggtaagaaattaccaggaataagtagtcaagaatgttttagatttaatcgcaatattgattttagtgtgcaaagaaacaagttagataaatacggtgctagtgaagtaggtaatattcttgttggaggtgctgggctgaaagatttaatgataaacagagtgcttaaatattttgatatgagcctatcttttgaagagaatttatatatgctcaagggcaaagagttagagaatttaggatttagagagtttgttaaagcatacggtgataatattgatattttatataaaaataaatatgccaacggtgttgataagtataattatttcaaaaaaatgggcagttcagaaactttagtgggctcaacaattgatggctggtttattaataataatggcgatttagaactattagagattaaaagtagcgactctaattatatgagtagtgctattgctgaggacaataaaaatggcaattttttaagcagtaaatattttttcaaatattatgtacaagcacaaatacagctagcatgcactgggcttaagtattgtaatttgttctttttaatagatgctgcaccaattaactgtaagattaaaagagatgaggccttaatatcaaaagtgtttgaatttgttaataaatgtgaattagaaattataaatttgaaaaaagatatttatagtaactatagagaggaatacttaatggcacataattttaacgaggatacgtttataaaacttgttgaagatttagtagaaaggagtgatttttatagttctgaagttgagtttgattgggtaagagaatttatagaatatgttgattgtgcagaccttgaaattaaggataatcaatttgctgaaaatcttgcgtatgatttaatggagattgatagtctacaaaaagaattaaatagaatccaaaacgaaaataaaaaaagagaaaagcccattaaagataggttgaagatgctaatttacaatattacgaatacatatccactaattgagcagttaaattataaatttggagagtttgtgtttactcttgaccctaagaaaagggcaatatcagatagattaaagggactactaccaacaagtggtacagtatttttccctagcaatatagcatttgcaaatagtgtcagtgtccccatgtgaatgggagcactaaaaaattaaaaaaataaatttaatataggaggattaattaatgcttattaataaaataaaacaagataatagaactttacgcccagagatacaaaggtggggttgttactttttgtgtctacattattatacaagcctatttaagaaatgtgaatttaatgcttatgagataaatgcagcgtattatagatttataggacttgggtacattaagagtaattgttttattataaatccatgtatgatacttaattattacggaattagaagtagtgtgagatatgagtctttaaattatttaggtgcagccaatgaatttgaaataagcgaagttaaaatcgataaggttaatggatatcactttatagcaacaaaaaataaagaaatattatatgattcacttgacttgaaacctcgtgggaaaatatttaaagtaacttcaaagcgtatatttagactaaagtagtttttttaaagtttaaggttattttgcatgcatttataagcgtgaattttattagcagcagagagtccataaatattatcaatttcggaagttgaatgatatttcataagttctttaatttgaaaagaattataaccattagattttaaatatgaaataaacaaatttctaaataaatgaagtgatttattagcacgaaatcctgactttttgagaagatttttgaatttattagaaatatggataatgctaatttgattatctttaaatttatgtttagttttttggaaaagataagtacgccgagagtcaagatttttttcattaaagtaattttcgtgagctttttgaatagcatcaaattctacagattttatgacaatttctctaatgcaagtgacatttctttttttagctacatttacttttatattgtaaaaagtttctccagttttgcttaaaaagggagtaatatcttgcatttttactttttgcagctcggcacctctgcagccacttattgccagtagatttaaaaaccaaccagaaattgggtcaatttattttaatgttttaacacatttttcaattattttgataattttttgattcaaataaaactttggagttggttttgaagcttttttagtaggcttagaagaaatttttagtgaatttttaagaattttgttttcatttaatacattttgatagtcttttaagaatttgtgcatcaaatctgtatcgaaattatttaaattaaaataattattagtatccataaaatcctctcctttgaagtgttacttttaaattaagtaaaagtaataaaaatttaataaaaatgtaatttatattttatcaaaaccctaaaattttagtcaaatttatggtgttctcattgcatgcgaaatttgggttgtggagtggctgtgataaacagaagaggcaatttttaaggggtggacttaagaaagacatgatactttaagtgatatatagcaaagactttgaaatttaatttgtatgtgttttgtagtcttttgtaatgagccgggcatttgcaatggagagatttttgggagttggttaaaattacatttgagttttgttaatatgtaatagctgaatgtaacaaaattatatatttaaatctttgaaatattgcaattattagctgttgtggtatgattaggacttatggagaaatttatgaataagaaaatgaaaatgtttattgtttgtgctgtttttatacttataggtgcttgcaaaattcatacttcatatgatgagcaaagtagtggtgagataaaccatactttatatgatgagcaaagtaatggtgagttaaaacttaaaaaaatagaattctctaaatttactgtaaaaattaaaaataaagataataatagtaactggacagacctaggagatttagttgtaagaaaagaagaaaatggtattgatacgggtttaaacgctgggggacattcggctacattcttttcattaaaagaatcagaagttaataactttataaaagcaatgactaaaggcggatcatttaaaactagtttgtattatggatataagtacgaacaaagtagtgcaaatggtatccaaaacaaagagatcataacaaaaatagaaagtattaatggtgctgaacatattgcgtttttaggagataaaattaataacggtgtggggggagataaaacagctgaatatgcaataccactagaagtgcttaaaaaaaatttaaaatagaatttagaaatataggagagaataattatgaataaaaaaacattgattatttgtgctgtttttgcgctgataatttcttgcaagaattttgcaactggtaaagatataaaacaaaattcagaagggaaaattaaaggatttgtaaataagattttagatccagtaaaggataaaattgcttcaagtggtacaaaagtagatgaagtagcaaaaaaattacaagaagaagaaaaagaagaattaatgcagggcgatgatcctaatggcagtggaataaatccgccaccagtattgccggaaaatattcacaataatgcattagtattaaaagcaatagaacaaagtgatggtcaacaagaaaaaaaagtagaagaagctgaagctaaagttgaagaaaataaagaaaaacaagagaatacagaagaaaacattaaagaaaaagaaataatagacgaacaaaacaaacaagaattagctaaagctaaagaagaagaacaacaaaaagaacaaaaaagacatcaagaagagcaacaaagaaaagctaaagcagaaaaagaaaaaagagaaagagaagaggcagaacaacaaaaacgacaacaagaagaggaagaaaaaaggcaagttgataaccaaattaaaacacttatagctaaaatagatgagatcaatgaaaatattgatgttataaaatggcaaacgactgtaggcccacaaggcgttatagatagaattactgggcctgtgtatgatgattttaccaatggcaataattctatacgcgaaacttgggaggggttagaagaggaatcagaagacgaaggattaggaaaattattgaaagaattgagtgatgctagggacgcgctaagaactaaattaaatgaaggcaataaaccatatactggttacgaagagcctaagttaaaagaaagtgtaaatgttagcgaaattaaagaagatttagaaaaattaaaatcaaaattagaagaagttaaaaaatatcttaaagatagttctaaatttgaagaaattaaaggatacatcagtgacagtcagtaattatattggatgcttttaggtgtaactaaatttgcgtatacaaagtaacagctagtagaaaagttcactggctgttatttttttgtagatttcattgttatgaatatagaaatgttttctatcaaaactttcatttaaaaaatgccaaaaactattgctcaaaatattgtttatttatatactatctataattaatatgcatactaatgaaatttcaaatttttatgataatcttagtgaagatttaaaaaagtcaataaataaactttatgaaaccgaacaagcaacgcaagaacaaaaaagtcaaatgtatagctcttataaagcagcgcaagaatacggaataaaaactggaaaaagcactgaggaaataataaatgacattatagaccctacaaaaaaaattattaaagacgttctgaaaaataaatatttaatacaaaaatataaaaattccaaaaatatgcaagttgattatagcgacaagaaagggatgctaaagaaatgtttgaaaaaattaggagagtatgattccatgatatttttgggggctgtttatggtattcttaaccatatttatcaaaaagtttcaaaacaatatcaattaattatgatcaacgaatttaaagatatactatttataaggatacacaactatgataagagaatttttacaagcgatgatctaattaaaacaataaaagattttccctaatttatatagtcaagttgttgcaaaattcaataaattagttaattgctatttctaaatcaataaaagtcaaaaaaataccaaacacctgtcaatagatatcaataagataatagttaatgttaacaattaacaaattgatttactatttagagtaacaatttgttaatttagttattttaggagaaattgttttgaaaagagctaaaaggtcttttaatgattatgttgcatactttagagaaggatcgttagatgatagagaaatatcggttaaattgggagtttctagggtaaatgtgtggagaatgagacaaaaatgggaaagtggagaaacttctgttagcgaggattctagagtaacaattagtgaagatacttttgaacaccttttgtcgcaaacctttagatcagaagttaacgctaggaaagttagaagcgaattggatttagagcgggctaatttagaattaggatttataaatgcatttaagcaatattctagtgttgagcttgttagtatgcatactaaaatagaaaatttaagagccgaaattgacgctttaaataaagcaagtagtaaaaaaaacaagcaagttgttaatggagaaattaattctttaaaaagcgagcttgatgaatatgtaaaggagtgctcaataagagaaatggagctttactatgaatgtatgaaaaaacttacaactgctcatgaagctgaaagtaaaagcaactacaaaaatagtaaagggaacaagtgaacttatatcaaacaaaactttttacaacactacaaaaggaatacaaaaataaatatggagttgacatatcacaatttgtaaagctagcaaattcttcaattaattttgataagtttgaagaaaaacagttaactttaaaacaaaaaaatgtgataaaaagtattaaaaagaataatgaaaaaaagattatactcagcggaggcatagctagtggcaaaacgtatcttgcatgttatctttttctaaaaagtttaattgaaaataaaaagttatactctagtgatactaataatttcattattgggaattcacaacgctcagttgaagttaatgttttaggacaatttgaaaagctatgtaaacttcttaaaattccttatatcccaagacatacaaataattcatatattctgattgattcactacgtattaatctatatggtggagataaggcaagtgattttgaaagatttaggggaagtaattcagcacttatttttgttaatgaggctacaactttacacaagcaaactttagaggaggtcttaaaaagactaagatgcgggcaagaaactattatttttgatactaatcctgatcatccagaacactattttaaaaccgattatattgataatatagcgacatttaagatatataattttacaacttatgataatgtgctacttagtaaaggatttatcgaaacacaagaaaaactctataaagatataccatcatataaagcaagagttttgctaggtgagtggatagcaagcactgattcaatttttacacaaataaatattactgatgattatatatttactagcccgatagcatatttagacccagcatttagtgttggaggggataacactgcattatgtgttatggagcgagttgatgataagtattatgcttttgtatttcaagaccaacgaccagccaatgatccttatattatgaatatggtaaagaccgttatagaaaatttcaatgtgcatacactgtatttagaggatagagataatacaaaaggtgctggtggattgacccgcgaatacatcttgctaagaaataatataagccaatattttagaattgttccagttaagccaaagtctaataaatttagcagaataacaatgttaattacgccgtttacttacaaaaaactttatattacaaagtacagtagttcttctgtatttaatgatatttattcgtataagggggatagcaaaacccatgatgatgctcttgatgcaatatctgcagcatatttgatgttgtctttaggatatagagagcgaagtgttcactttggcaatcaaagatttttgtaa

SEQ ID NO: 210 - DNA, 30750 bp, Borrelia burgdorferi
attttattgacaaaaatattagtttttgctatcatacatctaatttaataaagagaagtaaaaaggtgtgtgatttaagaaaaacaaaactaatagataaaataagttcactagaactatacaaatactcaatattttttagaaattacattgaaaatgtagcagaagattgtctcaagaacggacttattcttgagagtgctgcccacaatgttagtgaggttgaacttgctaggttaaaggtacagcttaagaatgctctgcttaattgtattataagctaccgttttcatgggattggctatgttttagtaaaaaccaaagataccctaatagatctcgaacaacccgttaatatagaattacctattggttttgaataccttgattatgaatatgtaagagatttgggagttgattttgatcatataacctataaagtaaaatccaacaataagaacaattctttagacgcagttaaaatacataaaagtcgacttatcatatatgaaaactttgattatatcttaaaaagatatgttccgtgttataccgaaagctttttactagatatttatttatttgaaaagatatacgtagaaatagaaagacgtattgaaaaccacaatttcttgttttataaagatgaatctttagtacaactacaagacgcactctctagtgcaacaacttctttaagtgcacttactcagagcaataatgataggggaagtggcattttatcttcttttttgagaaaacaaaattcaaacaatcatagtaaagatatttctaatttaagaaaccttaatgactcattatcacaggagcttgctaggctaaaaagcaatctaaataatgagggaatgttttatacggccacccctagtgctagtttagaggttattaaatacgatcttagctacttaaaggaggctttagcattaattaaggcaaaaattggtgcagatactaaagagcccttaaccagaagttttaatgagcaggctaaaggactaggaaatgatggtaaaggtgataggagtaattattacgattttctcaaaggtgtacaagaacaagttgagaactcttgtaatttaaaacttacaaagtattttgggcttgatatgaagtttaattctctgattatgttaagtgaagaacaaaaagtggaaagagatataaagctaattgagctttacagtaaatataaccagcttatacaaagtagctcatttaataatgaggagctagcgatgttaaaagagaaattattctcattttgagaaaaggagttaaaagatgactgagaaagaagaaaaagaagacctgcaggcacaagataaagaagagcagcaaattaaggctgatactaaagttatcagtgtgcaggaatttgaagagtacatgcgttttaaagagcaggcaaatagtaaatccaaagagacaagtcgagatttaagtataaatgaacgaataacaaaagaacttgcagaagttgaagagcgggagcgtattgaaaagcaattgttactagaggctgagcgaattaatgaaattgatacacttgcaaaagcacatcttagcaatcattttaacaaagaggtgctacttgcaaaaggatatacattaaaagacattatgcaagcacaacgtagagaacttgtacgcaagttcgttccaattgagcaaattaaagctattgccaaagtatcagacataagtcatatcgatggagagatattagagcaacttgtttctttagcaaaagtgaatattaaattaagaaaaaatgcgagtagcagttcttcttctgttgactctattaaggggaatattgctattaaatcagaagaaagagcaagtttgcttgattctaattttgtacctattaatttcacagaatttgtacaagcgataagtaatacatacaagcaaagacgaattcaattttatgaaaatctaaaaagacataaaagaacaagtattgcctaaaggagtttttaaatgagtgatataacaaaaattaaacaagaatttgataagaaagttgcagaaattcaagcattaatgaaaaatccccaacaagactcaggattgcttagcaattctattgattttagagaccaaaatctaattttttccaattctggtggggtttgcactagcagtaaagacaaaatagagaattaccctgctaaagggtatccgtataaacggggtgttaagcttagttttggagatggaacaaccgaactagaagttgaggctggtggtggagacgatttatatggagtgtgttccgatatagatgagtttagcggtatggcaactgttataccaattacaaataactttactgggtatttaacgctaaagaaagatggacaaaatggtgtaaatccaggagataaattaaattttaaccaacatggggaacttgaaaaggtcactggggctcaaaaatctgttaatgcaatagcactttcaaaggcacacaaattaactgaagatttatttatagtgcttgctagtgtatttgggaatagagcaataaaagggtaataaattatggctttaaaaggcaacatgcaagtagaaaatcttgaggctgttgaggacccacaggtagatttaggggcacaagtttccgctgctcctagagctaaacggcaagcaagacaagctgaggacgtacaaggggaagatccctatttggagtcaattagcgagcttgatgatgttcttttaaaatttaaaaaatattcaaaatcaatgagttcaattgaaaataaggtttttagcagttcaagtggctgttttaaatccaagaatgagcgagttgatgcatattcatttgcatgttcaagttatacagacaaaatagaggaatacctttacgatccagcgaatagttttccatacaaacgcggcgttaaacttgttccaaaagagaactctatatatgttgaagttggagctgatactgatatgtatgggatatgtgtagatgtatgtgagtttagttgtactgcatatgtattgccaattactaacaattttgaagggtatcttgttacaaggaatccaagtataaaaataggagaaatactagacataaataataacggtgttattatcaaggccggaggtgggccaccaaccgcaattaacatatatgctctatctgattcatttacaatcaattttgcacccgaagatggaaatcaagatcaaaatagatatcctaggcaagagtattctattaatttgataaaagttgcaatttttggaaatagaggccttgagaaaacagtaaatcctgatggtggttaaactttgggcgaataaaaggaggtaaataaatgggagatacaacgcaattagtaaaagagtatcaagagaaaagaagtaaactggaaaagtttatgaaaaatccccaacatgacgctagtttgcttagcaattctaatgaatttagagacaaaaatgtagaattttttgcttctggaggcactagaactagtaagtttgacaaattggaaaatcatccatttttggggtatccgtacaagcgtggagtaaaaagagttattcaagaggctcaagataatcaaagtcactatgagccacatgttgaggctggtggaggtgaagacttatatggaatatgcattgacatagatgagtttagtaaaacagctactattgtgccaattaccaataattttgagggctatttagtggcaaaagattctacggttaaagtaaaagataaacttatttttaataaagacggtgctcttgaaaaggtgactggagcaccaaataaagcaactattaatgcaacagcattgactgatgcaaaacaaattagcaatgaggtttatttagtaaaagtagctgtatttggaaataaagctatgagtagaaattaataatatttgggaggatttaatatggaattatttgatgaaaattattatgcaaaagctgtggcaaatatcataggagaagttaaagatcctattatgtataaatggttttcgcccgatcaaattgaagatgttgatctacaaatgggatatcaaaaaaccgtaaaatgggacgcgtttttaaatgctaatcctacaacaattgccaatgaggttaatactatctcaactattggatttagttctgaagtggtaagacttaattatttgaaattacagtataaattcagacatttaaagcagacttctgagaaattttatacttcagattcatatattggggacattaataataatttacttccttttgctcaagcgtataagcttgcaagtagtgaaattattaaacttattaatcactttgtattaaccgggactgtttcgattcaaaaagatgggaaaaatcaaaaacgcctgcttccaaatatgtatgggctgcttaatatgcccgagcagataaaagaagaggttgctagtggtgataaagataaaatggataaaatctttgaaaagattgaggctggactttcaaagttagaactgggcgacgaattttccaccccgatgatggtaatagttgacccagcaacgtcacttaaactagtaaaaccatacgcagcagcacagggtgcagcaagtagttgtgaaaaatgggaagatgttttaattcaaactattaaggctattaataatagagaagatgtttacattgaaacttcaaacttgctgaaacataaaatactcatttatccactaaattctgaacttattaaatttaaacctagcaagtatatgctacctacaccgaatgaacaagttgataaagactcaaccgatgtagctcattcatacattgattttgttttaggcggtctacttgctactagaaaaactattttgcaagttaacataaagcaaagttaaaagtataaggtaagtgaaaatgagtgaacaagaaagcttacaagcacaagttgcaggagaagaagaacttttagtaacaaaactccattcagaagtgttattgctattaggaatagacaaatttgcactaagcaggcaaaattttctacttcatttatccttacttcaagctattctagtaacacgcggtattgatgccagttcactgacgtatgaacaaatatttttacttactttctaccatatgggctgccaattaagaaaacagggagttgttcgagaatttgaatttgataggatcaaaaaagagaaattcaatgaacttgaacttgattattatcctagtagcagtggaggcgaagaaggcggcgaggggagttgtggctcaaacaagaatttttgttcacaacttgatgcatttttagaaaaactaaaaagagaaacttcaacgccatcttgtgtgggggttgtctaatgaatggtgttaggaaaagactttctgatatgtcatttcgcatgatcaacgtatttaaggatcctaaacccttaaagttttataaaggtactgttgtaaagcttgaaaatgattcttcttatcagagagtatttgataaaactaagtacattgaatttgcaggagttattattgacataaagccacaagaacttgcaattctttatgattctgatatgtctgatattcaaggatattccaaactttacacatatcaagaccttaactatgaaccaaaagaccgaatatcaattgcagatttagtttactttgaaatatttagtattgactcttcaataggatattttactttggttttaaaggaatttatatggacaaactagaatttaaaatggaattggaaattgggtggtttggtggtcgtgcaggtattgctaaaatgcatgaaaaagggagtagcaatttaccagcaagaaaacatttaaccaaaattgctagtagttctgagtttagagaatatatcaataatagctatataaattctaagtttaatcttgaccctaaatcgggaatggaggctattggacaagcttttataagatactatgaaaattatctactatcagcacaagtcactccagccttaaaggctaatacaatcaaaagtaagtttaaaaggggtagtaacactgcagcaattccacttgttgatacagccaaaatgttatcagagattacttataaggtaacacttgaatgattttcactttagatatggtattaaatcatttaacccaaatatttaaagggtttaaggcatatgcaactgaaaataattttgagtgcgatatcataaatacctacaatcatccatatctttcaaaaatcacagctgctagctcaaatataatagcattgaaatttgatggtacagaaaatctatttgatcataattatagagccggtgtattttatgaaaatgctttggaatttagtataaattttcaaatatatattattgcaatagtgttaaacgccaaagactttgacgctaattcacgcatgttaatgctttatagtatgcttagtgactttctacacaataaagctcataagtataatttgcccagtctacaacccgactatattaataaaattaacttctacatttacccaacatctaatatgcaaacagttggactgattaatttaggcacaaaatatagcaaccatgcatacagtgcatctatagcatttaatgctagtgtaaaagcaattgaaattttaaaggaggaatacgaaattgccgcaagatacaattagtgtaagtttgcttgactctagaattcaagctagtaggcctaattattataatccacttttggtttacaaaacagctaaaatcaaagttaataaagatgctgctagctataaaatattgaatttaaccgttaataattatgaaaaacaaattgaaactttagaaaaagagaatggaaatggagaagatcagtttggaaaagaaaaaacactgcttaaaactgcaatgtcaaattttttcaattcaagcgaagaatcgttaaaatcagccgatcttttcatttataaggataagcctgaagagctaaaaaattatcttaaagtacatagacacacttttgttgtacttattaacactgagggagatgcgtcagatgatggacttaaaatttacaaagatgactataataaattcaaaaagccttcaactttttttgtattctcgactaaagaacaagaaataaaagaactatttaaagataaaggcaatactgaaaaagaaagaaatattgctgtttacagcaacaataaagacaatttacaccttaaatttataagtcaatatctccatcaagctagtattttccatgctgtaaatccttatggcatgccgctggctgctacaccacttgttgatgatactgtaattggaaagttgcgaactgcaaaaatcaacttttattcacttcttaatgaaactgggcttgatggtgtacctgcctttaaagaaggtgttgacctagctggaggtgcaatagacgaacaatttacataccactatataaaaaacgaagcgattattgagcttattagaatttggaacaaaaacaataggcaaaatagcaaattatctgcactacaacttagtggagctagagacaatgcatatacttcagcaattgaatgtttactgaaaaggtttgtggatagaggactgataatagagtataaaaatttaaggcttactctttctcctacgccacaacttaaattagaacttagcgtgaatattacttataactttagcattaatgctgttgctttagtaattactactcaagatatagttgattatcaaaacagcttaagtgcttaaaaggggggctaaaaatgcaattttatgatttaagagaagtttatttttcaattggtggtacgcagttacatagtggcaagctagagcttacaagcgaacctacaacaagagcagtgattagtagtgaagataaaggtatgcctgtaataagcttaagagatcccaaaacaataacttatgttttcaacattgaagtgacactaggtagtcatgactacattttgttaactgaactttctgatgaacagttttacaacatggatgtgagaaaagaggataaaatgcttgatttagcattcaatgatagaattgctaccaaaattatttctaactatgcaatttttactgaagagccttcaagaagttattctgctgaggccgaaaaagtatcttttgaaattagggctattaattgccaaaaatctaaaccaaacaactcttaaaaggagattcttattatgataatgagatataaaatgaaaattttaactaaaaataaaacttatgaatatccgctgagagtacttcccgtctatgaatgggataaagtgctaggatttaatcaaagtgacgctgttttaaagcttaatgaggttaaatacttaagagaaatcacaagcttaatgataagtccaaaatttttagacgaattctatgtgattttggatcaaaatagagaatttatttcttattataaggactatcttgttgcaataatttacactgcacaatttaatacttttcatttagacaatgatctaaaaaagcccgctttagtatatttgagtgagtatgaaaataatgttggtgattttgttgcttttgactatattaatgaaaattttgattatgaaaaagtagccacttcactttcatcaagtacatcaaattccaatgagctggttgctaaatgaacaaaagaaatagagatattgataaagctattgcaagtcttgatgagactagaaaaaaatattttaacttgcttgacgagattaagaacgataaatactattttccagtaattatgaatatttgctcatacgactcggttaaaaaattgccttatgacgagcttttagaagtcaatagacttgctgagattaaattagaaaaagaattgtatgaattaattttaagcaagtgaggacttagtgagcgacaaattcaccattaaatttaaaggtattcttgatcatgctgcaacaaaaaaggccattgaacaagatatttctaaaatggaaaaatatcttaaacctaaaaaatctagtttgggtagcactaaagatattgtaaaaaataatttgtcggacaagaaaaaagaacttagtagacaatctaaatttgaaagcttaagagagcgtgttgagaaatatagacttacacaaactaaaaaacttataaaacagggcatggggtttgagaaagctagaaaagaggctttcagaagatctttaatgtctgatagagacaaaaggcgtcttgagtataaagaacttgcaaaagaatcaaaagcaaaaagtaaaatgttagcggcctctcaaggaaaaggacttgttgccaaaattgctataggtagtgccctagggaatatcattagcaacgctatgagtaaagttggaggaggccttttaggttttgctaaaaaagcggttgaagaagacaccaaaacaaaaagaacacaacttctcaataaagcgttttatggtgatccaaaagagaaagagggtcttttaaagattattggcggaatgaagggatttgagcgcgacctagaaaaagaagaattcttaaatcaagcaagtgtctttaagggtactttaagggatttagatatgttaaatgaaactaatttgaaaaacgcagtagaatttgcagctatgcttaaatccagtggtgctatgagcagcgaagatgcagtaaaggctgttaatagtgttcttgggggtgatggaagtgagctttttgatctattaaagaagtcaggtgttggagacaaatatatagaagatgccaaaatggcctggcaaagcggggcacaagtagatctagagtctagaattaccaagatgatggaaatgttcgaggattttaaatctttcggccttacaaaaaaagtcaataatgctgagagtattcaaagtaatttggcctcagctgagcaaactcttcaaaacttaaccactactgtcttggacccattacttgacctcattaataagataactaattactttaaagactttgcgtttgaaacacacattattaatcccataattaatggcattaaaagtatttttaatcttaattatttctttgcaaaattaaaatcgatgctacctggatggatgggcggagatgagggtgcggctctaaaaaaactacaagaagaaattcaaaatcaagacaatgctaacagcacaccataatttttacaaaaggtaattacttatgacaagtaacaaaaaaattgctaacaatgcagctaacaaaatagatattaataataaaattactaacaatcatgatattgaaaagaaaaaaatcaaggaaaaaattaatgatattgaaaagaaagaaatcagggagattactcgaataataagagatgtaataacccaaatatttgcccttttcggagcagataattttttagtgttatttcctagaatggatctaaaaggttttggatatattcctcaattgttttttataaaaccaaaaaatgaactcataacacgcacttataatactagttgttctaaaagaccagttatcaattattatgatagaaaagcggaatatgtaagctacaatccggtaatgactggtgaacatatatcattaaacgggggaatactaacatccttatataaggatatgatttctttactcaaaatgactgtttttggcaatactatgctacgctttgacgctcatcttgtaaaagaacaactagccaatagaatacaagcacaagtcccttttagtatatatagtccaacttttggccttaaagaattagctgtaattacaagtctttcgtttaaagatactcctttcattgacgaagttgaggttagtttatcaatagaaatagtaaaaacatttgcattggaaaaatataaaggataaaaaatgctgttactacaatatgattttaaaattgagttctacaatgtagatacatcaaaaaaatcacctgatggaattcctttcgccgaagaaattcctaaaattatcatcaatacacaagatggaattcatattgatatttccatatccaacgtgtattcaaatattcatactataagttccaaacaagcaaaagtcgtactttggaatcttcccttagacttcaccgacgacattaaatttggagatatagtaaaaatatattataagaaatttgctcatgaaaaaaattttgatttcataatggcaggaactttaggacctcctatgagcactgattatccgggtggggattttagtgtagatcttgatgttcgtttattaactaaaagcaatttcttcaatcgcgaattggcaggcaaagaaggcaaaaactttaaaggcaaaacggtgaaggaggcaatagaatctgtatttcccaatcgcaatatccttaatatggatgaaaaagattgtcttaaaattattgacaaagatatttatgccacaacaccaaaagagtttattgacaaaattaaaggaacatatgttcataacgtaatagccgatattggtactggtttacggggatatgaatgctatctgatatttactaattatataaaaaagggggaaaatgtccactacgaggcattagaagactatgggcttgaatttataccacaacaagaaattactttgggcacaacactcaaaaaaaatcttatattttggaacgcaaaaacatttttcacacataagttaaatgttggagataaagtctcatttattgatggactagggaaaatgataaaaaccactataaaagaaacaagtgcaaggcttagcaatacaggagagtgttcattaatattaaagttagaagatgattctaatacaaaacgtaaaaaataaaggggactagaattagaatgaatgaagactatgaaatttacagaatgaatcaacgcctttatggccaggcattggctcaagaagaccttaaaaattggatttattcaaacatttttataattaaaattggcactgtaaaggagtttaaacatcaaactcaagaagctattgttacaatacccgaatttgaagatttagaaattcacacaaaaaatatctctaatatcagtttagaactatcaaaaggtgattgcgttttactacttcaatcaagcattaatatttttgataaaaataacgatattcactttgacaaacatcatttttatatacttagtgcaattagcccaaagactttaaatctaatctctgatactgttaaaattagagcgaataataaaattgaaatagcaaaccaaacaactagcttaaaaaaaattctagataatattgttagtgctatcaatggtataaaaattataggggactcagtaattgacgaatcaagcttaaaaatagcaaccgctcaaattaattctgatattaatagtttgtttaagtaatttttgctaaatatggtataattactagtatggatttaagattaggcaataattttgaattggtatttaataacgatttatcacttgttgatggaattgatgaacaaaaacaaagatttttgatatttttaaaaaccttaaggggtagtttaagctatgctcctcattggggactggactatttcttgcttttaaagctgttaaaaattaacaatcttcacgctgtaaaaaattattttcatgaaatatctaaagagcttaacttagatttaataaatatttcaactactatacaagacaacaaagcacatatatccttttttttctcgggcgatgttttaaatatggagtttaatttatgagcatagtttttgattctgattttggcattttaaaacgtacaattaaggatattgtaagagctaaaagagaatatttgcgtgtaaattatggtattaatattgacgacaatcaaagctcaatttataacattattgcgtcttctttggcattaattgaagaagaaataattaatgagctcaatctctttttttctaaaatgaaacctggtggtacttattgggctgctattgaagaacacatttcttctaaaagcacaacttacagtgctgttcgcaatgctttacttaatcttgatgggattgagtacactaatattaaaagtgcagctggtaaagccaacatatatctaattctaaaggaaactttactagacactagtaaatctaatattaatagtcctgaatttaaagcaaaactttgggaaacattatatctaacaactcctagtggtactttacttgagggagacatagaaattgatggtctcaattcaactggacaacgtaaatcctataaaatatcactagggaaaagaaaatatgtttacatgaaagtaaagtataaacttgaccttaaaaactatctctacttaaacatagactctcaaattagggacatttattctaggattatttcaaataactattctgatatgggaattagctttgaatatcaagacttttttgctccagttaatgaagttaaaggaattaagtttatggaaataagtgcttgtattaaagatacagacactgagagtattacaaaaattggtgatagcgattttaaaaaaaatcaagatattgccattaatgatgacacaatgctacttttcaatatgacagatagattgcttattgatattggatagttaacaaatatgaaaatacccaatcttttcaaaaacaccgaaattcataaatttatacgtacagaaacagaatatgcacaagcattgcttaatgaacttaagtcccttaattccaacttcatatccattaatgtaatagaaaatataaaatcaagatatattgcaatatggatatctcaagttttatctatcttttatgcaaaaactcaaactttacaaagtattacaagcaatattaatagtgttatttttgctttacgtcatattggcactgacgagtcatttagactgattttcaagacctttttaaatgtggacattgaagttactactcctgaagctggggttattgatatctctttaaaaggggtaataaaaacaaactttactacatttatttcgcctagcactaagaaaggaaaacgactaaaaaagataattcttagagaaaagaagccgggatatgctgcatctaaaaaggctttagtattcaactcacttcctaagggctatgatcattcaatttatgcttttattaagagaattattcctattggtagagttctcaaaattaataatacagatggtaacaatattataacttttaacaactaaggaggttttatggctgatgatcaagaaaaattactaattgatgaagaagaaacggttcaaataaaagatttaaataaggttacgaccgttaacgatactgatcttttactgcttgatgatggagctgcaagcagtaatgctatcacctttaaaaactttttagatgcttctaaagacaaaatatttaaaggagagggattagactattttaagcagataattaagtctacaattgccgaagaacttgcagctgataaagattttgtagaaaaaatttatgctaaaataacggacaaattaattaacaacgattctactaatatttctaacctttttagtaaaattaaatcacgccttacagatagcatatcatcagccactttatctagaagtgatcatcttttgataatgccttcatcagatactattcaaaaaacacccgttcctaaacatatacttggagtaccatcaaatcttgcttatggcagcataactagaagtactacactttatccttctgactatgagaataacgcgatatttattaatatggaagacaatgatgatgtaactcttattttttctaaaagttacgataattctcccgtttatcttgatattgaaattcaagtaaaaatcaatgataataggatgcagaaaaaatcattaaaacttcagtattctgatgaaactacatacaatagggtttatgaaattgcgggcccccgcggactattcaccagaattcccatttataaaggatggtatgtccaaaaaagagcctccttgtatggagatccagtcccagatcttttaaaactgtaaactttttagcaaaaattatgattttggtatataatatacgtataaaaataaaaaattaaaatgaaggattaaaaaatggatactattaaattaaccgaacttcttatcaatttaaacgaaattaaacttatagcggtaatgatttttgtaacagtgctggttttaggagtattaattcttctcaagcctttactaaaagacatattgactattgtaataggcaagatttttaagaatggtaatggtaatggcaaaaatcacattaaaaaaagagattaacttatgaaattatccaaagataatgttgagcttggacttacgtctttatcaacccttattgatatattttctaaatttgaagatgaatttgatgaaattgcacataaaggattctttttggtttatgagctgtattctcattataaattaatctatacagcaaatatggaaagacttgagagtgcattaaccccagcaataaataaagcactcgctccattaaatgaaaaaatcaatcaatgcattgacttagttaattctgatgaaaaaaatctcaaaatatctaatgatctgaaattcaatcaggaaggaaaacctatctataaggaaagaacaaataatgcaaaataacactattggtttaggacttaatttactatccagcttaactaacatagctaaaactgatacaaacatagatcataattacattaatacttttagtaaagtaatagattttttctacaaaacatatataagcacactaaaatctatggaaacagctgagtcaactaaaatatttgaagaaataaaagacattttaaaatacaatattgagataatagaggctatctcttatgacaaaaataaaaaaattatcacttcacttaaagcaaaacgcaacaaaattatgaaagaatacatcaaaatgcttaaaaggagtgaaaatgcttaaaagattgcattgtttactaattgttttgttgttatgttgcaccactattgctaacctaccagaagaaccaaaaccgccaattattccaacgctaaaatctttagctaaatatgaaacacaactttcagaatatgttatgtatcttgtaacatttttagctaaaacaaaagtgaaagttaatgaccccaattatccagaatatccttatccagacttatcaacactaaaagacgaacactctatacctgcggtaaaacataacatcaagatatatttagagtacattaaaaaagcaaaaccaatagcggaaaaagtatatcatcaatattcgaagttaaaaatgtaaattacaaaaaggtttttcttgcaagaaattctaatttatgatcaaatcggcttttgcaacaaaagaaaaatctagatattagattgacgcagatttaatatctagattttaacattttcaacaggaatatttgctaattaattagtgccctcttcgaggaactttattactttgtctatctgttctacagcgtttttagacattttatccccattaccagaagtattgcttccaagaagtggtacagttactccaactaattttgcttctgaccatatttttctttttgaaatatcctgatccttgtcagtaatgttttcaatggtatttttagctgcttttaacgctgctaatttggccgctaatttatcctgaaaggaattttgcaaatttaatagtttttctttaagctccgcattgcctatatcttttaaattttcttttaattcatttattttgtctttataatctttaaatttgcctccagaagaatcatttacaagagctaaaacatcctccattaatgaatctatttctttcttttcttctacatatgctttacaagccattacaaataacattgctgcaaaaaataatttaaatatgtttttatttctcattagttactcctatattcaataataatgagataaaagctagcacaacatttgaaaaatataaatctctcaattaatatttttaaagatttttaaaaataagctctataattacaagaataaattttatttttactcaacatattgtactggagataaggaaaggaaataacaatgaaaatcatcaacatattattttgtttatttttactactactaaatagctgcaattctaatgataatgacactttaaaaaacaatgcacaacaaacaaaaagcaggggaaagcgtgatttaacccaaaaagaagcaacaccagaaaaacctaaatctaaagaagaactacttagagaaaagctatctgaagaccagaaaacacaccttgactggttaaaagaagctctgggtaatgatggagaatttgataaatttttaggatatgatgaaagtaaaataaaaacagcacttgatcatataaaaagtgaacttgataaatgtaatggaaatgatgcagaccaacaaaaaaccactttcaaacaaacagttcaaggagctcttagtggggggatagatggatttggttcaaataatgcagttactacctgcggcaatgggtcctaatagttaacagcccccatattgggggctttaatcttgctatgctgcaaatatctcatcaaaccgttcgtattcttttaagatactaaagaatattaatggactagggccataaataggcctcttaagccccataaacctttcaaaatcttgtaaatcctttaatctattatttttcttgaaatagttttttataatctcggcccaatagtttatgcttttaaaatcactatttttctcaaaatacgagattaaatcagattcaattttcttgatatcatcaaaattattggggtctatattctgaataaagcttattttttgaataattgagtttatattatcttttgttgtagggctatttacccagtcttttatattagacaaagcttctttaaaaacaccgtaataataaagcctatcttttttttgttcttgcttaatatctcttttctggttttgaatagtgttatttttttgaatttgattaatctcttgtttttgttctcttttttgttcttgcttttgattaacactaacttgcttgctaggcatagaattttcgttttcgtggttattgtaaataggagctgcatcagtatctatttcactttctataccaagagctgcaactaaagcataccttttgacataagtaatgcctgaaccaaacatctgatacactgtatttgtaactttagacccattttcattgttccattgtaaattttctgtaggaattcgcgtatcaaaagaaaattcatatccagtacttgtactgtagaatgtagtcctaatataatcaactatgccatattgaccctctatagaaattggatattgctcaatatcaagctccaaattgtgctttttaataacatttttaatttctctaactatttcattgaaattttgatatttatatccatatcctttaagacttttgtcaatccctggtaaattcatttttagggttttcatatcttttcggaagcttatttttgcttgaatattattttgtatttcttgattattgtttgaaagattttccatctttttactcctatggttatttataaaaataagtatatagcaaaaactatttttgccaacttttttacaaaaaattttacaaaaaaatagggcttagctaaattctctattatctactaaagaaattagttaagcccgtgctaaaaatttttttgcaaattaccataggtagtcaaaactgaaaaatgtttaaataactacgctgtttgtagtgtagcccaattttaaattaaaatcaatttatattttcactgaattaaaaatttctatattaatttaacaaaattaataattaaaatttaatatttttttagaaaagtatttacttttaaatcaaaattttgcattataataattaattattaattaccataggagaaaaaacatgaaaggtttttcaaataccacaaaaaatcccacttgccacaacaaacaccaacacaagttaatatatctagcttcaacactagattttctaaacaaaaaagataagaaatacacacaacaaaacatactctattactataatgaaaatctaaaaagaaatggtctagctcccactactctaagaacaatgcaaaattatctttacaaattagaaaaagtattaaaagtcacaactaattactaccaacatatgggtgtaaattgtggaactgaaatttactataagctaaagtatcctaaaaaagaatgttaccagaaaatcaacaagtactttaaagaacgaaaaaactctagatttaaatctagagttaataaccattttaaagacaatgtttccaaaaatagtagtgtaaattcagtggagtgtttaagtaataaaaataatataaaagaagaaagaaagattaacgaaatagaaaaatatcaagtaataaagtacttcaacaaaagtaacttcttatgtaaagaaattcttccatttttattaacattaaatgttgataaagatactatgattaaaataatcaaaaacataaaaagagttgaaaataaattgctaaaaaacacaaatttaaataaatcttgctttaaagaaaagcaagagaaactaaagaaaattctaaataacactcagaaagaattcgaacaaaatggatataatcccgaacaattaaagacaaatttacaaaaagtatacgaaaattacaaatttaagccccactttattattgaaaggcataaatataacgatttaaacaacataaaacgtaaattagaaaaggcgattgaaagggaaaagcaaaattctcaacaaaattatcaaaatttaaaggaaaatattttcaatatccttattgaacaactaaaaaaagaaacaaatattgaaattctaaagccaattatcaaaaaatatttgaataaccaaaagaaaatagaatacaataaagtatttggtatatatcatcttgaattatcagaaataataaaaaatgaaaaaaattctttaaccacagaagaatttagcataaaggccgtatgaggatttaacatggaaaatgcaccagaacctattgaaactgtaaaaaagggtaaatgtaaggttgaatgccaaaataaagaacgttttattttgattgaaaaagaaaatggtaaagcaatgtaccatacaaaaataatgatggacatttataaatttggagtttatgagaaaaaacacgaatttagattatcattgagggccttatttaacggggaaagaattgttgaagaaactcatttatacccaattaaagaaggagataagttcattggtattttttatggctacagaaaaccaattaaaaagccgttaataaagtatcaaataaatgggactaaaaaagcatatgcattagcaagggcatattatatggaatttagatttaaagcaggaagtgttttttgctattttaaagggctatatcgattattagataaaaaaagaacaaataatcactacaacaaagttttatttagtatgtttacagatttagaacaacaagtatataaattttatgggaaaaaatacccggagcaaggaccgttaataaaatggatactaaaaaacctaaaataataacaatagcgtcaattaagggcggtgttggcaaaagcacaagtgcaataattttagcaacgctattatcaaaagacaacaaagtacttttaattgatatggatacacaggcttcagttactagttatttttataaaacattagtagaaagtgaatttgatttacttgaaaaaaatatatatgaagttttaaaaggaaatcaattaataaatgatgcaattatcaatgttgatcataattttgatttgttgccaagttacttaagcttgcacacttttagtgaagagcccttgccttataaggaacataggttaaaggatagctttaaatatttaaaatttaaatataattttattatacttgatactaatccccatttagattctacgttatccaatgctttagttgttagtaaacatgttatagttccaatgactgcagaaaagtggactattgagagtttgcaactattagagttttttacggataaattaaagttaaaacccaaagtatttttatttgtaacaaaatttaaaaaaaataaaactcataaagatttattagaaatgttgcaaaaaaaagaaaagtttttggggataatatcagaacgtgaggatttaaataggagaatagcaaaaaatgatagatttgatttagataaagattatataaaggagtatgtaaacgttttaaataattttattttgaaaatatgaaatttgtccgatagttggatgaatttttttaacaaaaaggataggagattaattatggacgtgggaataaaaataaacgatagggtaatatcaaaaaaggaaataaaaaaagaattaagcaataaagatgaaatattaaagcattataatttgttgaaggagcgcttgaaatctaattttcaaaaagaaatctataataagatagagagtatgaaaattttaaaagaaataaaagataatgaatactataaacttgatggttataaaagttttgatgcttttataaaagattataagttagccaaaagtcaaacttatgaatatttgaagatagcatcagctatagaaaatggcgtaatagaagaactttttttattagaaaatggaattaaagaaactataatctttttaagaaatagtaattcagatacggttaaaaaatcaaaacaaaatccaataaaaccattaagatttcaacttaaaagcaaagaaagttatgatttttacaaaagtaatgctaaattcacgggatttttattagatgaactttttgaaagtcaaaaagatttgattaataaattcttaagaagatataagcaattaaaaggatagtaaaggtattttatgactaatttagcgtacaaaacgtataacatagaaagcataaaaaatgagtttttaaacataggatttagtgaagaggcaatagattttgttttgcttcataatgaaaattacagctttgaggttttaaaagaaaaattgattaatgtagagaagaatttgcaaaaagatatatctagtttggacattaagatagatactgtagaaaagaatttacaaaaggatatatctaatttagacattaagattgatgccgtggaaaagaatttacaaaaggatatatctaatttagacatcaagattgataatgtagaaaagaatttgaaaaaagatatatctagtttagatactaagattgatgttgtagagaagaatttaaatctaaaaatagattttgtagaaaagagtttaaatgccaaaatagatagtttagacgttaaaatagataatgtaaataataaagtagattatattaaaagtgaacttattgccaagatagatagtgtagaaaaagggttaaacgaaaaacttaatacaggaaataggctaatacattttatgatattaacagcagcgattctaggcccagttttaaatgccctatttatgagatatttacaatatatcaaataatgatgtaatgcataatttgcttttttcaaatagtttattatcaattaaagcttatttaagcttttaaataaagtaacttaaataagttcttttattttaataaatacaaattgattttaattctaaattgaactgaatttaattgtttagtgagttcacctaaaataaattaagctaagcccgcggctttattaagctctttaacatgagaatttaataaagcttttatttattataataatttctgtaaaaagcctgacaaaaatagtttttgttatacatatgtatatgtatagctaaaaaaatatattgctatcaaaaaaatccaattaagttgggtttagctaagttctttaacaagagaatttagctaagccctatttttttgtaaaattttttgtaaaaaagttggcaaaaatagtttttgctatatacttatttttataaataaccataggagtaaaaagatggaaaatctttcaaacaataataatccacaagaaaatattcaaggagagctcaaaatgataagtgttaatcaacaaagttttactggttgtgaaataattgaggaaaaatcttctcccattaaagaaaaaagtaaattaagtaagataggtaagaaattgccaggaataagcagtcaagaatgttttagatttaatcgaaatattgattttagtgtgcaaagaaacaaacttgataaatacggtgctagtgaagtaggcaatattcttgttggaggtgctggacttaaagatttaatgataaacagagtgcttaaatattttagaatgagcctaccttttgaagagaatttgtatatgctcaagggcaaagaattagagaatttaggatttagagaatttgttaaagcacatggtgataatattgatattttgtataaaaacaaatatgctaacggtgttgataagtataattatttcaaaaaaatgggcagttcagaaactttagtgggctcaacaattgatggctggtttattaataataatggcgatttagaactattagagattaaaagtagcgactctaattatatgagtagtgctattgctgagtacaataaaaatggcaattttttaagtagtaaatattttttcaaatattatatacaagcacaaatgcagctagcatgcactgggcttgagtattgtaatttgttctttttaatagatgctgcaccaattaactgtaagattaaaagagatgaggccttaatatcaaaagtgtttgaatttgttaataaatgtgaattagaaattataaatttaaaaaaagatatttatagtaactatagagaggaatacttaatggcacataattttaacgaggatacgtttataaaacttgttgaagatttagtagaaaggagtgatttttatagttctggagttgagtttgattgggcaagagaatttatagaatatgttgattgtgcagaccttgaaattaaggataatcaatctgctgaaaatcttgcgtatgatttaatggagattgatagtctacaaaaagaattaaatagaatccaaaacgaaaataaaaaaagagaaaagcccattaaagataggttgaagatgctaatttacaatattacaaatacatatccactaattgagcagttaaattataaatttggagagtttgtgtttactcttgactctaagaaaagggcaatatcagatagattgaagggactgctaccaacaagtggtacagtatttttccctagcaatatagcatttacaaatagtgttagtgtccccatgtgaatgggtgcactaaaaaattaaaaaaataaatttaatataggaggattaattaatgcttattaataaaataaaacaagataatagaactttaagaccagagatacaaaaatggggttgttactttttgtgtctgcattattatacaagtctatttaagcaatgtgaatttaatgtttatgagataaatgcagcgtattatagatttataggacttggttacattaagagtaattgttttattataaatccatgtatgatacttaattactacggaattagaagcagcgtgagatatgagtctttaaattatttgggtgcagcaaatgaatttgaaataagtgaagttaaaatcgataaggttaatggatatcactttatagcaacaaagaataaagaaatattatatgattcacttgatttaaagccacgtgggaaaatatttaaagtaacttcaaagcgtatatttaaactgaaatagctttactaaagtttaaggttatttttcatgcatttataagcgtgaattttattagcagcagagaggccgtagatattatcaatttcggaagttgaatgatatttcataagttctttaatttggaaagaattataaccattagattttaaatatgaaataaacaaatttctaaataaatggagagatttattggcacgaaatcctgattttttgagaagatttttaaattttctagaaatattgataatatcaatttggttatctttaaatttatgtttggttttttggaaaagataagtacgccgtgagtcaagatttttttcgttaaaataattttcgtgagctttttgaatagcctcaaattcttcagatttgatgacaatttctctaatacaagtgacatttctttttttagctatattaacttttatattgtaaaaagtttctccagttttgtttaatagaggagtaatatcttgcatttttactttttgaatttcggcccccctacacccacttattgcgagtagatgtagaaaccaaccagaaatagggtcaattttttttaatattttaacgcatttttcaattattttgatagcttttggggtcaaataaaacttaggagttggttttgaagcttttttagtaggcttagaagaaatttttagtgaatttttaagaattttattttcatttagcacattttgataatcttgaaatagtttgagcataaaatccatgttgaaattatttaaattaaaataattattagtgttcataaaatcctctccttgaaggtgttacttttaaattaagtaaaagtaataaaaatagataaaaatagtaatttatattgtaccaaaaacgaaaaattttagtcaaattttgtgagttctcattgcatgagaaatttgggttgtagggaggctgttataaatagaatgggcattttctgagggtgtcggctaagaaagactacatactttagctaatatatagcaaagactttgaaatttaatttgtatgtgttttatagtcttttgtaatgagtagtgcatttgcaatggagagattttggggagttgtttaaaattacatttgcgttttgttaaaatgtaacagctgaatgtaacaaaattatatatttaaatctttgaaatattgcatttattatgtattgtggtatgattaggacttatggagaaatttatgaataagaaaatgaaaatgtttattatttgtgctgtttttatacttataggtgcttgcaagattcatacttcatatgatgagcaaagcaatggagaggtaaaggtcaaaaaaatagaattctctgaatttactgtaaaaattaaaaataagaataatagtaataactgggcagacttaggagatttagttgtaagaaaagaaaaagatggtattgaaacgggtttaaacgctgggggacattcggctacattcttttcattagaagaggaagaaattaataactttataaaagcaatgactgaaggtggatcatttaaaactagtttgtattatggatataatgacgaagaaagtgataaaaatgtcattaagaataaagagataaaaacaaagatagaaaaaattaatgatactgaatatattacatttttaggagataaaattaataacagtgcggggggagacaaaatagctgaatatgcaatatcactagaagagcttaaaagaaatttaaaatagaagttagaaatataggagagagcgtatatgaataaaaaaacaattattatttgtgcagtttttgcgctgatactttcttgtaagaattatgcaattaaagatttagaacaaaatgcaaaagggaaaattaaaggatttatagataaggctttggatccagcaaaagataaaattacttcaagtagttcaaaagtagatgaattagcaagaaaattacaagaagaagataaaataaagggtgtagaagaaaacaataaagatgaattaatgcagggtgatgatcctaatagtggtgtaataaattcgtcaccagtattgccagaaaatagtcaagataatacaccaatattaaaagcagcggaacaaagtgatggtcaacaagaagagaaagtgaaaaaagtagaagaatccgaagctaaagttgagggaaaagaagaaaaacaagagaatacagaagaacgaaacaaacaagaattagctaaacaagaagaagaacaacaaaaacgaaaagcagaacaagaaaaacaaaaaagagaagaagagcaagaaagacaaaaaagagaagaagagcaagaaagaaaagctaaggcagaaaaagaagctaaagaaaaagcagaaagacaaaaacaagaagaacaacaaaaacgaaaagcagaaaaagaaagagaagaacaacgaaaagaggcagaaaaaaggcaagttgataacgaaattagaacacttacaggcaaaatagatgaaatcaatagaaatattgatgttataaaagagcaaactagtgtgggggcacaaggtgttatagatagaattacagggcctgtatatgatgattttactgatgggaataaagctatatacaaaacttggggggatttggaagatgataacgacgaaggattaggaaagctattaaaagaattgagtgatactagacataatttaagaaccaaattaaatgagggtaataaagcatatattattgatactagaagcactgaaccccaattaaaagaaaatgtaagtgttagcgaaattaaatcagacttagatgaactaaaatcaaaattagaagaagttaaagaatatcttgaagataaagataattttgaagaaattaaagaatacgttgctggtagtgaggataattatgatgaagaagattaattttagatataactaaattttgtatacacaaaataacaactagtaaaaaaatgactagttgttatttttttgtagatttcattgttataaatatagaaatgttttctatcaaaactttcattcaaaaaatgccaaaaactattgctcaaaatattgtttatttatatactctctagagttatgatgaatataaatgagatttcagatttttatgataatttatataagagaacaaaaaaagaaatagataaacttataaacaagctctatttaactagccaaataactctaaagcaaaaaagacaaatatacagtgctgttgaaaaaatgcaaaagtacgtaataaaaaccggaaaaagtgtttttttagaatcggaaaaagaatttgttaaagacactttgaaaagaaaaaatctaacaaaaaaatttcaaagtttcaaagttgattttagctacaaggaaggaatgctagaaaaatgtttagaaagattaggagaagataaatctatcgaatttttgatttttgtttgccaaattcttaatgggataagagaaaaagtatcagaattagactttcaaatagatgcgattaaagaatttagagatattttatttttgagtatacactattatgataaaagacttttcaccagtaagaatcttatgaatgaaatgaaatactttttcgaaaaagtagagttaatttatagttatatgcaataaattagtgaactgctatttctaaatcaaaaattatagaaatagcagcgaactaaatcaataaaagctaacagatattccctgttaaatatcaagaagttatcagtttatgttaacaattaacaaattgctttactatttagagtaacaaattgttacttttgttattttagaggatttttttgaaaaaagttaaaagatcttttgatgattatgttgcatattttagagaaggatcgttaagtgatgtagaaatagcgaagaaattaggagtttctaaagtaaatgtgtggagaatgagacaaaagtgggaaagtggagaaagtgttgttaacggggactctagagtaacaattagtgaagatacttttgaacaccttttgtcgcaaacctttagatcagaagttaacgctaggaaagttagaagcgaattggatgtagagcggtctaatttagaattaggatttataaatgcatttaagcaatattctagtgttgagctttttagtatgcatactaaaatagaaaatttaagagccgaaattgacgctttaaataaagcaagtagtaaaaaaaacaagcaagttgttaatggagaaattaattctttaaaaagcgagcttgatgaatatataaaagagtgttcaataagagaaatggagctttactatgaatgtatgaaaaaacttgctacggttaatggagctgaaagcaaaagtaactacaaaaatagtaaagggcacaagtgaacttatatcaaacaaaactttttacaacactacaaaaggaatacaaaaataaatatggagttgatatatcacaatttgtaaagctaacaaattcttcaattaattttgataagtttgaagaagaacagttaactttaaaacaaaaaaatgtgataaaaagcattaaaaagaataatgaaaagaagattatactcagcggaggcatagctagtggcaaaacgtatcttgcatgttatctttttctaaaaagtttaattgaaattaaaaagttatactctagtgatactaataatttcattatagggaattcacaacgttcagttgaagttaatgttttggggcaatttgaaaagctatgtaaacttcttaaaattccttatattccaagacatacaaataattcatatattctgattgattcactacgtattaatctatatggaggagataaggcaagtgattttgaaagatttaggggaagtaattcggcacttatttttgttaatgaggctacaactttacacaagcaaactttagaggaagtcttaaaaagactaagatgcgggcaagaaactattatttttgatactaatcctgatcatccagaacactattttaaaaccgattatattgataatatagcgacctttaagacatataagtttacaacttatgataatgtgctacttagtaaaggatttgtcgaaacacaagaaaagctatataaagatataccatcatataaagcaagagttttgttaggtgagtggatagcaagcactgattcaatttttacacaaataaatattactgatgattatgtatttactagcccgatagcatatttagacccagcatttagtgttggcggggataacactgcattatgtgttatggagcgagttgatgataagtattatgcttttgtatttcaagaccaaagaccagctaatgatccttatattatgaatatggtaaagactgttatagaaaatttcaatgtgcatacactgtatttagaggatagagataatacaaaaggtgctggtggattgacccgtgaatacatcttgctaagaagtaatataagccaatattttagaattgttccagttaagccaaagtctaataaatttagcagaataacaacgttaattacgccgtttacttacaaaaaactttatattacaaagtacagtagttcttccgtatttaatgatatttattcgtataagggggataataaaacccatgatgacgctcttgatgcaatatctgcagcatatttgatgttgtctttaggatatagagagcgaagtgttcactttggcaatcaaagatttttgtaa

SEQ ID NO: 211 - DNA, 52971 bp, Borrelia burgdorferi
caacttcagtttatattatcaaacgataaataaaacattaagtacaataacccaatatttcaaaaaagatgcacattttaataaaaaactaaagctgttcaactgcaattgttgcacttgaaattttttatactaaaataaaatacaaataattatattaacaaatatcgatttttataaaaaataagtaaaagtagtctagtttacctgagtatttaaatacttttaattgaggatgttttattttaaaaaggagtgtaaaactatgtcaaaagctgttgacgaagtatattgctattcttgtggcaagatttaaaaaagatgctgagatttgtatttcttgcggagtcagaaataaacaaaccgaaaactacaataaacttatagtatttttactatgcttactttttggttatttaggagttcacagattttatgtaggtaaaataggaactggtctattatacctatttacatttggatttttatatgttggagttttaatcgatcttattagaataacaacaaacaagtttaaatgtaattaaaaggattctttagtaaattttttattagtcttgttaaaattattttttaattttttaagcacattttgtgtgaactgctatttctataatctttgatttagaaatagcagttcactagataataataaagctaaaattaatattttagtatttaataattcttgagaaaaggtaaaattggtatatgtttacttgttatagaaaaatctatcttggtaggacttttaatgtttaataaaatagtgattagataaacttgtatatttacaacagattatttttgtagtaaggtgggtaaggagcatatatgaggattttggttggcgttttcataatagcagcattggctttattgggttgttatttgcctgataatcaggaacaagctgttcaaactttttttgagaattcggaaagtattgatatgggttccgatgagattgttactgaaggcatattttctagtttaaaattatatgcgtctgaacatcgtttattggttgagataaaaaagactttaattagtttaaaagatcctaattatcgtgatgtacccccagtgcgtgactataatgaggagtattttaataaattctttttagatttaggttctgagcaatctaaagacttgattaagttgtttggtagggtaaaaaatgagcagaataataaatttaaaagtgaagtttattggctgtattcatgtataagcgagttatattctccagatattaagtattctggcgaagaggggagccctgagtatgatcgttttatgcctagacccactgcttatcaacaatatttaaaagtgaagagagaaatagaaagaaatacaattaatggaaaaattttatgaaaaagaacatatgtattttgaatatatttttatatataccattattttattcatgctttttgactacaccaaaatcttcaaaaatcaacagtatcaaaaccgaggttttggattttaagataattgaagagggaaatattataaaatatgataaaaagcccattgaagagagtaatagcaatatttgtcttacctttaaggaacccgaattaaacgaaataaaagaaggagaggcatttgaaatacttgcaagtggttatgttacatgggcaaaatctggtgatttaaaagatataaaagataaaaataacaatttaattgaaaatcttagagagcttaagtattcttatattttttcacccatccgattcaaaacttattcattgcttacctttagctatacttaattatagcattaatgacaataactataaaatattcggtcaagaagtacctatagctaagataatagcatttgaatcaactgaagagtttgaaaacaaatatgaaatcaaaagtttaaaactaaattctgaagagtcgaatattgattttgaacaaaatagaactggttttgccaaaatcaatttaaaagaaacttcaagggaacctcaatacatttattcatataattttggggtttttgacaattccttagtagattattttaagctcttttacaagaaaagtaaatgcaactatatgcctgcatatcttactataaaagataaacaaacaaataaagataaaacctacgaaatcatattaaatctaaagctatttaataatactattagattaatatttaataagtattcaaatttatcaaaagaaaaattaaaactttttactgatgaatgataaaaattgaataagaaaagcaaagacaaaaatttatcaattaatgtaaataaatacaattcaaaattgataaagttgtgtgacatattcggcatctcaacttgtcgatttaaaagtattgataataaaaaccaattttagccctttttcaaagatgttatttaattaatcggttttacttattaaggctaatattaaatatttagaatatttaaattttcaagaccgcaagtatcaaatatttatttctcaatggaccggattatattattattaaaataattaaacttgttaaaaatcaatcaaggatatataaaacagattttttaaaatattataaaacttttgataataaaagtatccttgtattatatataataatatttttaattaaatagataaaatatattattgatattgaatttgattaaataattaagcatactaaatacagagccattcaaggagagtatttatgaaatactatatatgtgtgtgtgtttttttgcttttgaatgcttgcaattcagattttagcactaatcaagaagatattaaatatccatctgataaagagaaatcaaaatccaacatggaagcaagctctaaagaagaagatccaaataaaaaaataaaaaatacactgcttaatgatttaataaatttgatagaaatagctaatgagcataaagaaaaatatgaaaaaagaatgcaagaagaaccttcagatcaatacggaatattggctttccaggaattagacttgtccgttggaaaaatatctgaagacaccccgcaatctaaaaaatttagaaaaaacacctattctcccttaagcgctattgatgtcaataaattaaaagatctttcagagattataagaaattcgggccaaatacaaggtttatttaatattttcaacagattcggaggcatttttgacgactcacttaatcacgtatattctaaaaaagatatcctagggggactagaaattttggatttagataaactaaaaaattcgtttgaaaaattactatctataaaagaaactttctcaaaaatgctaaatcaacttttattagattataaaaatgataaagatcatatacgaacagagacaaataaacttaaatctcatacaactgcacttttcgaacaacttgataaaaaagaagacgaagcatatgaacctaaaaatcagatattttcaataagtaacctttaaaaaaagattcaactccatatataaaatttaaaaattgtgctaacattcatttataaaaacttaattattaggaggtaatattaatatgaaaaaattttcacattaatattaatttttagtttaacaatgcaaatctttgcacaagagaaacttgaaaaaggtgttggagatattgcaaccgtaatgaaatatgaaagtaaaaaagcaaccatattagcaccattacttttgaacatctttttatctttaggaataggatcctttgttcaaggagattatattggtggtggtgcactacttggctctcaagtgcttggaggaatacttataatggctggatacatgaccggggatattggattcgttacagaaagcacagcaacagtaataaccggaggagtattatcaggaataggagggctcacaattgcagcatcctacatcactggaattatcattccatttaaatttgctaatagatacaacgcagaccttaaaaaaagactcggcattgcacttgcggggcttgaacccaattttgacattggaataaacggggattccaactatcgtttaaaaaatcctattgaatatcaatttacctggggttaagagagattattaatgcaaataatctctcttcaaagcctactaaaaaaattcattgatactatttcgaaatcaagaattacataaataactttttgtctcaattcacaaaagttttttaaatttcacaagatttacctaaactaaagtagtaataaaaatgaaaaaagtcccccccaaaagggacgctttgattgcgacgataattgtggaaggacaaacgacatcatccagcctaaaataacaatagcaccatatatgataaaaatcaagtatttgtttttattctttttttttcttttatatttttcatattcattaattagatctgataagacttcttttttagtaaaaaaaagtctttcaagaatataacacgctcttttagtatcttctttacaaaacgtataaaactctttattcttcataaaaaacctgatagacatttttttattatttacttcggacaaattttctttttttacgtttaataaattctctttcaattgtctttgcaagcctctaaatcctgtttctttaatattatctatagagatagctccttctaaaaccttttcataaacttttaaatacaaatacgcttgtgtttttgcaattacaaaatgttttataaattgctcaaaactagaaaaattatcatatttgtaaagttctttttttttaatttcgtataaaattttcattctttcaattttattatcaatatcatcttttaaattatattttaatttctcctttaaattattgtaattaatcaaatccttatcttgcatgttatctatatttgtcaactctttattcatatgactgaaagtcctactatttaagactagctcttttttgttgtattttttccccatcttatcatcctatcttacttataaaaaagtgcgccgtgcggcgctgaacgactcaatagttactaataatccatttctaaacttagaaatgcaaattaataatattttctaaagtattttttgtttcctcataatatgtttcttttacagaaggttctaaaagttcatttataagaacttttacactattgtagtaatgaatttttccctttatgtaaaaagaatattccttataaagcagttcttctacatctttaaatgtatttctattttttagaaactgattttctataatcgaaatattaaagcttttatttctaaaatctttaatatcattaatggtttgcattaaaatacttaaactttctacagagaatctttctacttgaactggaattattatataatctgtaacattcaaagaattttttaaaataaaacccaagttgggtggggtgtcaagtaagatataatcaaaattataatttgtaatatttctattcaaaatattttctaaaagaagatctttataatttaaaatttctgaattaaaattttctaaaataggatgagatggaattatagaaataaaatcattaattttattaatacactgtccaaaataaacatctttttttaataagctgtaagaattgcatttatcaatgttgaaaatatatttactaaaataagaacttaaagaattctgtggatctaagtcaatcaatagaacttttttgcttaaatcttttaatatataagaaaaaagtattgttaatgtggttttacctacacctcctttagggcttgcaattgttataatgtttgattcttttctatccatttgtttattattccttcctcttttatttttttattgtaaaattcgtaaactgttttttccatgttttttatattttctaatgtaaatttatagtattttgtttgttttttttcttttcttagtaatgtccatagggactgaacgtaacacttaatagatccttttttaaatacatattctatgtaatatgccttttttactacatattttatattattattgcctatgataaaaaaaggtttctcgagattatcccaaccgtattttatgcctaaaaatttttcatcttcttttattggaaatagattgaaaaaattccatcctccagtatcattaaatttttggaaggttatcctaagaccctttctagtaatttcaaatttgattaaatgcttaaatattattgaataatatgtttttttattctccttttcttctattttataaaagaagattcttttttttgttttctttttaagatttctaaatctttctgtaaagttgttcaaatttttttccttttataattagctagtaaatcaaatagaaatgttttattttgatttattttccatttattgatgtaagtgtctttaaattctcctacaattttgaagaaatctgtttcgtagtgagcattttgtctcatgaagtgaattttatttttatatttttttagcttttttaagtaaaactcttttatatcttttgtttgatagtcgtattttaaatgcttgttgaaatctttgtaatttataaataacaatggggttattatcaaggctggtggtgggccaccaaccgcaattaatgcatatgccctctctgattcatttacaatcaattttgcacccgaagatgaacatcaagatcaagctaaacatcccaaacaagagtattctattaatttgataaaagttgcaatttttggcaatagaggccttgagaaaacagtaacacctgaagctggtggttaagccttgggcaataaaaggagttaaacaaatggcagacacaacgcaattattaaaagattatcaagataaacgaagtaaacttgaaaagtttatgaaaaatccccagtatgacgctggtttgcttagcaattctgtagagtttagagataaaaacatacaattttttgcctctggaggcactagaaccagcaaatttgacaaattagaaaatcatccattttctgggtatccatacaagcgtgggataaaaagagttattcaagaggaaaaagctgatcaaattcactatgaaccccacgttgaggctggtggtgaagatgatttatacggaatatgcattgatatagatgagtttagcaaaacagccactattgttccgattacaaataattttgagggttatttagtagcaaaagattctacgcttaaagtaaaagacaaacttgtttttaataaagacggtgctcttgaaaaggtgactggagcaccaccaaataaggcaactattaatgcaatagcgttgtctgatgcaaaacaaattagtaacgatgtttatttaataaaagtagcagtatttggaaataaagctgtaagtaaaaattaatgatatttgggaggatttaatatggaattatttgatgaaaattattatgcaaaagctgtggcaaatattataggagaagttaaagatcctataatgtataaatggttttcgcctgatcaaattgaagatgttgatcttcagatgggctaccaaagaactgtaaagtgggatgcgtttttaaatgctaatcctacaacgattgctaatgaggttaatactatttcaactattggatttagttctgaagtggtaagacttaattacttaaaattacagtacaaatttaggcacttaaagcaggcgtctgaaaaattttacacttcagactcatatcttggtgacattaataacaatttacttcctttctctcaagcctataagcttgcaagtagcgagattattaaacttattaatcactttgtactaacaggcactgtttcaattcaaaaagatggaaaaaatcaaaaacgtctacttcccaatatgtatggacttcttaatatgccacatcaagtaaaagaagaagttgctagtggtgataaagataaaatggataaaatatttgaaaaaattgaggcgggactttcaaagttagagctaggagacgaattttctacacctatgatggtaatagttgaccctacaacttcgctcaaactcgtaaagccatacgcagcagcacagggtgcagcaagtagctgcgaaaaatgggaggatgttttgattcaaactatcaaggctattaataatagagaagatgtctacattgaaacttcaaacttgctaaaacatcaaatacttatttacccattaaacccagagcttattaagtttaaacctagcaagtatatgttacctacaccaaatgaacaagtggataaagattcaactgatattgctcattcatacattgattttgttttaggagggttacttgctactagaaaaactattttgcaagtacatatcaaacaaagttaaaagtataaggtaagtgaaaatgagtgaacaagaaaacttacaaacacaagttgaggctgaagaagaacttttggtaacaaaactttattctgaagtgttattgttactaggaatagacaaacttgcattaagcagacaaaattttctacttcatttatctttacttcaagctattctagtaacacgtggtattgatgctagttcacttacatatgaacaaatatttttacttaccttttaccatatgggttgtcaattaagaaaacagggagttgttcgagaatttgaatttgataggatcaaaaaagagaaattcaatgaacttgaacttgattattatcctagtagcagtggaggcgaagaaggtggcgaggggggttgtggctcaaacaagaatttttgttcacaacttgatgcatttttagaaaaactaaaaagagaaacttcaacgccatcttgtgtgggggttgtctaatgaatggtgttagaaaaagactttctgatatgtcatttcgcatgatcaacgtatttaaggatcctaaacccttaaagttttataaaggtactgttgtaaagcttgaaaatgattcttcttatcagagagtatttgataaaaataagtacactgaattcgcaggagttattattgacataaagccacaagaacttgcaattctttatgattctgatatgtctgatattcaaggatattccaaactttacacatatcaagaccttaactatgaactaaaagaccgaatatcaattgcagatttagtttactttgaaatatttagtattgactcttcaatcggatattttactttggttttaaaggaatttatatggacaaactagaatttaaaatggaattggaaattgggtggtttggtggtcgtgcaggtattgctaaaatgcatgaaaaagggaatagcaatttaccagcaagaaaacatttaaccaaaattgctagtagttctgagtttagagaatatatcaataatagctatataaattctaagtttaatcttgaccctaaatagggaatggaggctattggacaagcttttataaggtactatgaaaattatctactatcagcacaagtcactccagccttaaaggctaatacaatcaaaagtaagtttaaaaggggtagtaacactgcagcaattccacttgttgatacagccaaaatgttatcagagattacttataaggtaacacttgaatgattttcactttagatatggtattaaatcatttaactcaaatatttaaagggtttaaggcgtatgcacctgaaaataattttgagtgcgacatcataaatacctacaatcatccatatctttcaaaaatcacagctgctagctcaaatataatagcattgaaatttgatggtacagaaaatctatttgatcataattctagagcaggtgtattttatgaaaatgctttggaatttagtataaattttcaaatatatattattgcaatagtgttaaacgccaaagactttgacgctaattcacgcatgttaatgctttatagtatgcttagtgactttttgcacaataaagctcataagtataatttgcccagtctacaacccgactatattaataaaattaacttttacatttacccaacatctaatatgcaaacagttggactgattaatttaggcacaaaatatagcaaccatgcatacagtgcatctatagcatttaatgctagtgtaaaagcaaccgaaattttaaaggaggaatacaaaattgccgcaagatacaattagtgtaagtttgcttgactctagaattcaagctagtaggcccaattattataatccacttttggtttacaaaacagccaaaattaaagttaataaagatgctgccaactttataacattgaatttaaccgttaataactatgaaaaacaaattgaaactttagaaaaagataatgggaatggacaagatcagtttggaaaagaaaaaacactgcttaaaactgcaatgtcaaattttttcaattcaagtgaagaatcattaaaatccgctgttctttttatttataaggataaacccgaagagttaaaaaaatatcttaaagtacatagacacacttttgttgtacttattaatactgagggtgataattccgatgatggacttaagatttataaagatgattatgataagtttaaaacaccttcaattttttttgtattctcgactaaagaacaagaaataaaagaactatttaaagataaaggcaatactgaaaaagaaagaaatattgctgtttacagtaataataaagacaatttacacctcaaatttataagtcaatatttacatcaggctagtatttttcatgctgtaaatccttatggcatgccgctggctgctacaccacttgttgatgatactgtaattggaaagttgcgaactgcaaaaatcaacttttattcacttcttaatgaaactggtcttgatggtatgcctgcctttaaagagagcgttgatcttgctggaagttcaatagacgagcttttcacttatcattatataaaaaatgaagcgattattgagcttattagaatttggaacaaaaacaataggcaaaatagcaaattatctgcactacaacttagtggtgctagagacaatgcatatacttcagcaattgaatgtcttcttaaaaggtttgtcgacaggggattgattatagagtataaaaacttaaaccttaccctttctcctacaccacaacttaaattagaacttagtgtgaatattacttataactttagcattaatgctgttgctttagtaatcactactcaagatatagttgattatcaaaacagcttaagtgcttaaaaggggggctaaaatgcaattttatgatttaagagaagtttatttttcaattggtggtacacagctacatagtggcaaactagagcttacaagcgaacctacaacaagagcagtaattagtagtgaagataaaggtatgcctgtaataagcttaagagatcccaaaacgataacttatgtttttaacattgaagtgacattaggtagtcatgactacattttgttaactgaactttctgatgaacagttttacaacatggacgtgagaaaagaggataaaatgcttgatttagcattcaatgatagaattgctaccaaaattatttctaactatgcaatttttactgaagagccttcaagaagttattctgctgaggccgaaaaagtatcttttgaaattagggctattaattgccaaaaaactaaaccaaacaacacttaaaaggagagtcttattgtgataatgagatataaaatgaaaattttaactaaaaataaaacttatgaatatccgctgagagtacttcccgtctatgaatgggataaagtgctaggatttaatcaaagtgacgctgttttaaagcttaatgaggttaaattcttaagagaaatcacaagcttaatgataagtccaaaatttttagacgaattctatgtgattttggatcaaaatagagaatttatttcttattataaggactatcttgttgcaataatttacactgcacaatttaatacttttcatttagacaataatctaaaaaagcccgctttagtatatttgagtgagtatgaaaataatgttggtgattttgttgcttttgactatattaatgaaaattttgattatgaaaaagtagccacttcgctttcatcaattacatcaaattccaatgagctggttgctaaatgagcaaaagaaatagagatattgataaagctattgcaagtcttgatgagactagaaaaaaatattttaacttgcttgacgagattaagaacgataaatactttttcccagtaattatgaatatttgctcatactactcggttaaaaaattgccttatgacgagcttttagaagtcaatagacttgctgagattaaattagaaaaagaattgtatgaattaattttaagcaagtgaggacttagtgagcgacaaattcaccattaaatttaaaggtattcttgatcatgctgcaacaaaaaaggccattgaacaagatatttctaaaatggaaaaatatcttaaacctaaaaaatctagtttgggtagcactaaagatattgtaaaaaataatttgtcggacaagaaaaaagaacttggtagacaatctaaatttgaaagcttaagagagcgtgttgagaaatatagacttacacaaactaaaaaacttataaaacagggcatggggtttgagaaagctagaaaagaggctttcagaagatctttaatgtctgatagagacaaaaggcgtcttgagtataaagaacttgcaaaagaatcaaaggcaaaaagtaaaatgttagcggcctctcaaggaaaaggacttgttgccaaaattgcaataggtagtgccctagggaatatcattagcaacgctatgagtaaagttggaggaggccttttaggttttgctaaaaaatcggttgaagaagacaccaaaacaaaaagaacaaaacttctcaatagtgcattttttacagataacgaacgaaatatgattatgggaaataaagacaagaatactaagggaattcttgacggaatgaaaggttttgagcgagacttagaaaaagaagagtttctacatcaagcaagtgcctttaagggtactctaagggacctagatatgttaaatgaaactaatttgaaaaacgcagtagaatttgcagctatgcttaaatccagtggtgctatgagcagcgaagatgcagtaaaggctgttaatagtgttcttgggggtgatggaagtgagctttttaatctattaaagaagtcaggtgttggagacaaatatatagaagatgccaaaagggcttggcaaggcggggctgaggtagatctagattccagaattaccaagatgatggaaatgttcgaggattttaaatctttcggccttacaaaaaaagtcaataatgctgagagtattcaaagtaatttggcctcagctgagcaaactctttcaaatttgaccactactgttttggacccattacttaatatcattaactggatcaccgctaaaattaaaaattttgattttaccaaagatattatcaatcccataattaatggcattaaaagtatttttaatcttaattatttctttgccaaattaaaatcggttctacctacaatgttcggcggagatggcggcgaagctttaaaaaaactgcaagaacaggctgagaatcaagacaatgctaacaacactccataattttggtaaaaggtaattacttatgacaagtaacaaaaaaattgctaacaatgcagctaacaaaatagatattaataataaaattactaacaatcatgatattgaaaagaaaaaaatcaaggaaaaaattaatgatattgaaaagaaagaaatcagggaaattactcgaataataagagatgtaataacccaaatatttgctctttttggagcagataattttttagtgttatttcctagaatggatctaaaaggttttggatatattcctcaattgttttttataaaaccaaaaaatgaactcataacacgcacttataatactagttgttctaaaagaccagttatcaattattatgatagaaaagcggaatatgtaagctacaatccggtaatgactggtgaacatatctcattaaacggtggaatactaacatccttatataaggatatgctttctttacttaaaatgactgtttttggcaatactatgctacgttttgacgcgcatcttgtaaaagaacaactagccaatagaatacaagcacaagtcccttttagtatctatagtccaacttttggacttaaagaattagctgtaattacaagtctttcgtttaaagatactcctttcattgacgaagttgaggttagtctgtcaatagaaatagtaaaaacattcgcattagaaaaatataaaggataaaaaatgctgttactacaatatgattttaaaattgagttctacaatgtagatacatcaaaaaaatcaattgatagaattccttttgccgaagaaattcctaaaattataatcaatacacaagatggaattcatattgatatttcaatatccaacgtgtattcaaatattcatactataagttccaaacaagcaaaagtcgtactttggaatcttcccttagacttcaccgacgacattaaatttggagatatagtaaaaatatattataagaaatttgctcatgaaaaaaattttgatttcataatggcaggaactttaggacctcctatgagcactgattatccgggtggggattttagtgtagatcttgatgttcgtttattaactaaaagcaacttcttcaatcgtaagttagcaggcaaagaaggcaaaaactttaaaggcaaaacggtgcaggaggcaatagaatctgtatttcccaatcgcaatatccttaatatggatgaaaaagattgtcttaaaattattgacaaagatatttatgccacaacaccaaaagagtttattgacaaaataaaaggaacatatgttcataacgtaatagccgatattggtactggtttacggggatatgaatgctatctgatatttactaattatataaaaaagggggaaaatgtccactacgaggcattagaagactatgggcttgaatttataccacaacaagaaattactttgggcacaacactcaaaaaaaatcttatattttggaacgcaaaaacatttttcacacataagttaaatgttggagataaagtctcatttattgatggactagggaaaatgataaaaaccactataaaagaaacaagtgcaaggcttagcaatacaggagagtgttcattaatattaaagttagaagatgattctaatacaaaacgtaaaaaataaaggggactagaattagaatgaatgaagactatgaaatttacagaatgaatcaacgcctttatggccaggcattggctcaagaagaccttaaaaattggatttattcaaacatttttataattaaaattggcactgtaaaggagtttaaacatcaaactcaagaagctattgttacaatacccgaatttgaagatttagaaattcacacaaaaaatatctctaatatcagtttagaactatcaaaaggtgattgcgttttactacttcaatcaagcattaatatttttgataaaaataacgatattcactttgacaaacatcatttttatatacttagtgcaattagcccaaagactttaaatctaatctctgatactgttaaaattaaagcaaacaataacattgaaatagctaaccaaacaactagcttaaaaacaattctcaaaaatattgtaagtgctattgagggtataaaagtcgtacccgcacaaggaggcccagcaattgaatcagtcagtctaaaaatagcaaccactaaaattaattctgatattaatagtttgtttaagtaatttttgctaaatatggtataattactagtatggatttaagattaggcaataatttcgaattggtatttaataacgatttatcacttgttgatggaattgatgaacaaaaacaaagatttttgatatttttaaacaccttaaggggtagtttaagctatgctcctcattggggactggactatttcttgcttttaaaactgttaaaaattaacaatcttcacgctgtaaaaaattattttcacgaaatatctaaagaacttaacttagatttaataaatatttcaactactatacaagacaacaaagcacacatatccttttttttctcaggcgatgttttgaatatggagtttaatttatgagtatagtttttgattctgattttggcattttaaaacgtacaattaaggatattgtaagatcgaaaagagaatatttgcgtgtaaattatgggattaatattgatgataaccaaagctcaatttataacattattgcgtcttctttagcattaattgaagaagaaataattaataagcttaatctctttttttctaaaatgaaaccgggtggcacttattgggctgctattgaagaacacatttcttctaaaagcacaacttacagcgcggttcgcactgctttacttaatcttgatggggttgagcatactaatattaaaagtgcagctggtaaagccaacatatatctaattttaaaggaaactttactagacgatagtaaatctaatattaatagtcctaaatttaaagcaaaactttgggagacattatatctaacaactcctagtgggactttacttgagggagacatcgaaattgatggcctcaattcaactggacaacggaaatcctataaaatatcgctagggaaaagaaaatatgtttatatgaaagtaaagtataaacttgaccttaaaaactacctctacttaaatattgactctcaaattagggatatatattctaggattatttcaaataactattctgatatgggaatcagctttgaatatcaagacttttttgctccagttaatgaagttaaaggaattaagtttatggaaataagtgcttgtattaaagatacagacactgagagtattacaaaaattggtgatagcgattttaaaaaaaatcaagatattgccattaatgatgacacaatgctacttttcaatatgacagatagattgcttattgatattggatagttaacaaatatgaaaatacccaatcttttcaaaaacaccgaaattcataaatttatacgtacagaaacagaatatgcacaagcattgcttaatgaacttaagtcccttaattccaacttcatatccattaatgtaatagaaaatataaaatcaagatatattgcaatatggatatctcaagttttatctatcttttatgcaaaaactcaaactttacaaagtattacaagcaatattaatagtgttatttttgctttacgtcatattggcactgacgagtcatttagactgattttcaagacctttttaaatgtggacattgaagttactactcctgaagctggggttattgatatctctttaaaaggggtaataaaaacaaactttactacatttatttcgcctagcactaagaaaggaaaacgactaaaaaagataattcttagagaaaagaagccgggatacgctgcatctaaaaaagctttggtatttaactcacttcctaaaggctatgatcattcaatttatgcttttataaagggaattattcctattggtagagttctcaaaattaataatacagatggtaacaatattataacttttaacaactaaggaggttttatggctgatgatcaagaaaaattactaattgatgaagaagaaacggttcaaataaaagatttaaataaggttacgaccgttaacgatactgatcttttactgcttgataatggagctgcaagcagtaatgctatcacctttaaaaactttttagatgcttctaaagacaaaatatttaaaggagaaggattagactattttaagcagataattaagtctacaattgccgaagaacttgcagctgataaagattttgtagaaaaaatttatgctaaaataacggacaaattaattaacaacgattctactaatatttctaacctttttagtaaaatcaaatcgcgccttacagatagcatatcatcagccactttatctaaaagtgatgatcttttgataatgccttcatcagatactattcaaaaaacacccgttcctaaacatatacttggagtaccatcaaattttacttatggcagcataactagaagtactacactttatccttctgactatgagaataaagcgatatctattaatatggaagacaatgatgatgtaactcttattttttacaaaaattacgataatgatcccatttatcttgatattgagattcaagtaaaaatcaatgataataggatgcagaaaaaatcattaaaacttatgtattctgatgaaattacatacaattgggtttatgaaattacgggccctcgcggactattcaccagaactcccatttataacggatggtatatccaaaaaagagcctacatgtatggagattcagtcccagatcttttaaaactgtaagcttttttagcaaaaattacgattttgatatataatgtatatacaaataaaaaattaaaataaaggattaaaaaatggatactattaaattaacagaacttcttatcaatttaaacgaaattaaacttatagccgtaatgatttttgtaacagtgttggttttaggagtattaattcttctcaagcctttactaaaagacatattgactattgtaataggcaagatttttaagaatggtaatggtaatggcaaaaatcacattaaaaaaagagattaacttatgaaattatccaaagataatgttgagcttggacttacgtctttatcaacccttattgatatattttctaaatttgaagatgaatttgatgaaattgcacataaaggattctttttggtttatgagctgtattctcattataaattaatctatacagcaaatatggaaagacttgagagtgcattaaccccagcaataaataaagcactagctccattaaatgaaaaaatcaatcaatgcattgacttagttaattctgatgaaaaaaatctcaaaatatctaatgatctgaaattcaatcaggaaggaaaacctatctataaggaaagaacaaataatgcaaaataacactattggtttaggacttaatttactatccagcttaactaacatagctaaaactgatacaaacatagatcataattacattaatacttttagtaaagtaatagattttttctacaaaacatatataagcacactaaaatctatggaaacagctgagtcaactaaaatatttgaagaaatacaagacattttaaaatacaacattgagataatagaggctatctctactgataaaagcaaaagaattatcacttcacttaaagcaacacgtaacaaaatcatgaaagaatatatcaaaatacttaaaagaggtgaaaatgcttaaaagattgcattgtctactaattgctttgctactatgttgcaccactattgccaacctaccagaagagccaaaaccgccaattattccaacactaaaatctttagctaaatatgaaacacaactttcagagtatgttatgtacctagtaacatttttagctaaaacaaaagttaaagttaatgatccaaattatccagaatatccttatccagacttatcaacactaaaagacgaacactccataactgcggtaagacataatattaacatatatttagagtacattaaaaaaacaaaaccaatagcggaaaaagtctataataaatattcccagttaaaaatgtaaattacaaaaaggtttttcttgcaagaaattctattttacatataaaaatctctaaagccaattaatctaaaatagtatataatatgaccataagggaaaattttatggaaacagtgtcaacaaatattgcaagtgtaactcaagaacaaatatataaagaatttattagactgggtatggaacaactaatagcacaagatttatctaaaagatattatcacaatgagctaacatatagagatttagaaaatttagaaaaacaatttgatataaaatttgataatcttatttttaagattgatagcgtagaaaagaatttacaaaaagatatatccaatttagacgttaagattgatactgtagagaagaatttaaatgccaaaatagatggtgtagagaagaatttaaatgccaaaatagatggtgtagagaagaatttaaatgccaaaatagatagtgtggaaaagaatttaaatctaaaaatagatagtttagatactaagatagatactgtagaaaagaatttacaaaaggatatatctaatttagatactaagattgatactgtagagaagaatttaaatgttaagattgatactgttaaaagcgaacttaatactaaaatagacaatgtagaaaagaatttacaaaaagacatatctaatttagatgctaaaatagataatgtagaaaagaatttaatgtctcttacagaaatgcttaaatgggtattaggaatcatgggagcaatgtctatcacaatgatagccgggctaatatttgctttcatttctaaatagctactacctcacttaaaacatatcaattcaaataataattgtttatcccatatttagtattaataattgattaagtgaatattaataataaaaaaaggagtaacaatgaaaatcatcaacatattattttgtatatctttgctactactaaatagctgtaattccaatgataatgacactttaaaaaacaatgcccaacaaacaaaaagcaggaaaaaacgtgatttaagccaagaagaactgccacaacaagaaaaaatcactttaacatccgacgaagaaaaaatgtttacttcattaatcaatgtgtttaaatacacaattgaaaaattaaacaatgaaatacaagggtgcatgaatggaaacaaaagtaaatgtaatgacttctttgattggctttctgaagatattcaaaaacaaaaagaattagctggtgcttttaccaaggtttacaacttcttaaaatcaaaagcacaaaatgaaacttttgatacttatattaaaggagctattgattgtaaaaaaaacactccacaagattgtaataaaaataataaatatggggatggtgacaacttaatagagcaatattttagaggcgtcgctaatgatatgtctaatagaaattctaatgaagaaatttatcagtaccttaaagatgaacttttaaaagaagataatcattatgctggtcttacagctaattggcaaaactaaaaacatttctcaatcaaaaataaaaaccttaattattatacctatagcagcccccaaatagggggctttaatattgctatgctgcaaatatataattaaattgtctttcttttttcaacatacaaaagaattttaatacttttgttttataaacatcccgattatcagacataaatactttaagcttatttagatcatcaaatctattagttttattgaaatatttttttaaaaaatttacccaatattctatactcttaagctcagcattcttttcaaaaagatcttctaaagcatcatcattatcagtacataatgcccgaataagagcatttatattatttttttcttcaccttcatttacccaattttttatattaaacagtgcgtctctaaaaatttcatagcaataagccttgccagattttaagtttttattaaaggtgttcagttgatttttttcttgatttatgtcctttttttgttcttgtttttgattaacactaacttgcttgttagacatagaattttcgttttcgtgattattgtaaataggtgctgcatcagtatcaaattcactttttatgtcaagatacgcaactaaagcataccttttaaaataagtaatagctgcaccaacaagttgtggcattgtattcaaatttttagacccattttcaccgttccattgtaatttatctgtatgaattaatgtatcaagcgactctttgtatccagtacttttactgtaaaatgtagtcctaacaacaggaacttcaccatttttaccatacacaaaagttggaaattgccaaaaaccaagctttaaattgtgattttttataacattttgaattacttctactatgacattgaaatcttgatacttatatccgtatcctttaagacttttgtcaataagtggcaagttcattcttaaagtatccatatcatttaaaaagtctatttctgcttgaatattattttgtatttcttgattattattgtttgaaagattttccatctttttcctcctgttttttcaataaatataagtatatagcaaaaactatttttgccaacttttttacaaaaatttttacaaaaaaatagggcttagctaaattctctattatctactaaagaaattagttaagcccgtgctaaaaatttttttgtaaattgaaaaaacaggtagttaaaactgaaaaatgttcaaataactacgctgtttgtattgtagcccaatttagaattaaaatcaatttatattttcactgaattaaaaatttctatattaatttaacaaaattaataattaaaatttaatatttttttagaaaagtatttacttttaaatcaaaattgtgcatcatattattaattatttattgaaaaaacaggagagaaaatatgaaagattttccaaatatcacaaaaattccaacttgtcacaacaaacaccaacacaaattaatatctcttacttcaacgctagattacctaaacaaaaaagataagaaatacacgcaacaaaacatactctactgctttaacgaaaatctaaaaaggaatggtctagctcccactacactaagaacaatgcaaaattatctttacaaattagaaaaagtattaaaagttacaactaattactaccaacacatgggtgtaaattgtggaactgaaatttactataagctaaagtatcctaaaaaagagtgttaccagaaaatcaacaagtactttaaagagcaaaaaaactctagatttaaatctagagttaataaacattttaaagacaatgtttccaaaaatagtagtgtaaattcagtggggtgtttaagtaataaaaataatataaaagaagaaagaaagattaaagaaatagaaaaatatcaactaagaaattatttcaataattgtaactttaaaacggaagaagctctttctattttgtatttaaatattgataaagatactaagattgaggcaataaatatcttaaaacaaaatgaaattgccctaataaaaaaattcaatataaaaaaatcttgcatgaaagaaaaacaaaaaaaattaaaagaaattctatacaacactaggaaaaaattagaagaaaacgggtacaatcccaaacaattagaaataaatttacaaaaagtatacgaaaattacaaatataagccccattttattattgaaaatcataaatatagcgatttaaacaatataaagcgtaaattagaaaagtcgattgaaagaaaaaaagaaaattctcaacaaaattatcaaaatttaaaggcaaacattttcaatatccttattgaacaactaaaaaaagaaacaaatattgaaattctaaagactattgtaaaagaatatttgaataaccaaaagaaaatagaatacaataaagtatttggtatatattatcttgaattattagaaataataaaaaatgaaaaaaattctttaaccacagaagaatttagcataaaggccgtataaggatttaacatggaaaatgcactagaacctattgaaactgtagaaaaaggtaaatgtaaagttgaatgccaaaataaagaacgctttattttaattgaaaaagaaaatggtaaagcaatgtatcatacaaaaataatgatggatatttataaatttggagtttatgagaaaaaacacgaatttagattatcattgagggccttatttaatggggaaagaattgttgaagaaactcatttgtacccaattaaagaaggagataagtttattggtattttttatggctacagaaaaccaataaaaaagccattaataaagtatcaaataaacggggctagaaaagcatatgcattagcaagggcatattatatggaatttagatttaaagccggaagtgttttttgctattttaaagggctatatcgattattagataaaaaaagaacaaataatcattacaacaaagttttatttagtatgtttacggatttagaacaacaagtatataaattttatgggaaaaaatacccggaacaaggaccgttaataaaatggataataaaaaacctaaaataatcacaatagcgtcaattaagggcggtgttgggaaaagtacaagtgctattataatggcaacattgcttgcaaaagagcataaagttcttttaattgatatggatacacaagcatccactacaagttatttttataaagaaattttaaatcaaaatattgatattgtgaaaattaatgtatatagagtgttaaaagaaaaaatagatattaatgattcaattgtaaagattaaagaaaatttagacttaatccccagttatttaactttaaataaatttttaagcgaatccataccattaaaagagttaaggttgcaaaataatttagaatttttaaagcggaggtatcattatgtaataatagatactaatcctagtttagattacactctgtcaaatgctttaatgactagtaattgcataatagttccaatgactgcggaaaaatgggcggttgaaagtttagaattattggaatttcatatgaacaatttaaaaataaaaattccaatatttttggttataacacgatttaagaaaaacaatactcataagcaattgttacaacacgttgaatctaagacaggatttttgggatttatccatgaacgagaagatttaaataaaaaaattgctaaaaatgaagagtttgatatgaccaaagattatattaatgaatataaaggggtattatcaagatttttaattgtatatgatgaatatgttaaataaatccatacggatccgtatggatttcaaataaaagaggtttattatggaaatagaattaaatgagagagttatatcaagggcaacagatcctgacggtgaaaaaaaattaattaccaaagaggagatatttgctcattacaatgatttaaaaaatagattaaagactaatataaaaaagaaaattttttataaggtcgaaagtattagaattttaaaagaaatcaaagataatgaatactataaacttgatggttataaaagttttgatgcttttataaaagactatcaattggcaagaacgcaagtttatatatatctaaaattagcaaaagcattacaagcaggaattcttaatgaagattatataattgaaaatggtatttacaattctcttgataaaatagagagtcaagaaaccccaatagtaaaaaaatcaaaacaaaatccaataaaacccttaagatttcaacttaaaaagcaagaaagttatgatttttataaaagtaatgctaaatttacagggtttatgttagataaattatttagtgatggaaaagaaataattaaaaaacttatgaaagaatataaagaattaaaaggataatatggagattttatgaatagtttgacttacagaacatacaatatagaaagtataaaaaatgagtttttaaagataggatttagtgaagaggcaatagattttgtttttctgcataatgataattacaactttgaatttttaaaagaaaaattgattaatgtagaaaagaatttacaaaaggatatatctaatttagacattaagattgatactgtagaaaagaatttaaacactaaaatagacaatgtagaaaagaatttaaacactaaaatagacaatgtagaaaagaatttaaatctaaaaatagataatttagactctaaaatagatactgtagaaaagaatttaaacactaaaatagacaatgttgaaaagaatttaaacctaaaaatggatggcttgaatatcaaaatagacaatgtagaaaagagtttaaatcaaaaacttagcatgggtaacagactagtacattttatgataataacagcagcaattctagggccaattttgaatgccctatttatgaaatatttacaaggtggcaaataataatgtattgtaaaatttgattttttaaaatggtacattataatattgataaagagtattatcaattaacacttaatttttgctttttcataaattagaacttatttgaattttttaacaagagaatttaaataggttcttttattttaacaaatacaaattgattttaattctaaattagaatatattcaattattgaaaagcttatttaaattattttaataagcaaatttgattaaaccctaactttattaaaataatttatgtaaaaagttgtcaaaaatagtttttgttatacatatatatatgtatgtaaatagctaaaaaagtttattgctatcaaaacaatccaatcaagttgggtttagctaagttcttagataagagaatttaaataaacccaactatttttttgtaaaattttttgtaaaaaagcctgacaaaaatagtttttgctatatacttatattttttactataaaaggagtaaaaagatggaaaatctttcaaacaataataatccacaagaaaatattcaaggagagctcaaaatgataagtattaatcaacaaagttttactggttgtgaaatatttgaggaaaaatcttctcccattaaagaaaaaagtaaattaagtaagataggtaagaaattaccaggaataagtagtcaagaatgttttagatttaatcgcaatattgattttagtgtgcaaagaaacaagttagataaatacggcgctagtgaagtaggcaatattcttgttggaggtgctgggctgaaagatttaatgataaacagagtgcttaaatattttaatatgagtctaccttttgaagagaatttatatatgctcaagggcaaagagttagagaatttaggatttagagagtttgttaaagcatacggtgataatattgatattttatataaaaataaatatgccaacggtgttgataagtataattatttcaaaaaaatgggcagttcagaaactttagtgggctcaacaattgatggctggtttatcaataataatggcgatttagaactattagagattaaaagtagcgactctaattatatgagtagtgctattgctgagtacaataaaaatggcaattttttaagcagtaaatattttttcaaatattatatacaagcacaaatgcagctagcatgcactgggcttgagtattgtaatttgttctttttaatagatgctgcaccaattaactgtaagattaaaagagatgaggccttaatatcaaaagtgtttgaatttgttaataaatgtgaattagaaattataaatttgaaaaaagatatttatagtaactatagagaggaatacttaatggcacataattttaacgaggatacgtttataaaacttgttgaagatttagtagaaaggagtgatttttatagttctgaagttgagtttgattgggtaagagaatttatagaatatgttgattgtgcagaccttgaaattaaggataatcaatctgctgaaaatcttgcgtatgatttaatggagattgatagtctacaaaaagaattaaatagaatccaaaacgaaaataaaaaaaaagaaaagcccattaaagataggttgaagatgctaatttacaatattacgaatacatatccactaattgagcagttaaattataaatttggagagtttgtgtttactcttgaccctaagaaaagggcaatatcagatagattaaagggactactaccaacaagtggtacagtatttttccctagtaatatagcatttgcaaatagtgttagtgtccccatgtgaatgggtgcactaaaaaattaaaaaaataaatttaatataggaggattaattaatgcttattaataaaataaaacaagacaatagaactttaagactggagatacaaaaatggggttgttactttttgtgtctacattattatacaagtctatttaagaaacgtgaatttagtgcgtatgagataaatgcagcgtattatagatttataggacttggatatattaagagcaattgttttattataaatctatgtatgatacttaattattacggaattagaagtagcgtgagatatgaatctttaaattatttaggtgcagccaatgaatttgaaataagtgaagttaaaatcgataaggttaatggatatcactttatagcaacaaaaaataaagaaatattatatgattcacttgacttaaagccacgtggaaaaatatttaaagtaacttcaaagcgtatatttaaactgaaatagttttactaaagtttaaggcactttttagcacattcataagcttgaattttattagcagaagataggccgtagatattatcaatttcattggttgaagaatatttcataagttctttaatttgaaaagaattgtagccgttggatttcaaatttgaaataaataaatttcgacatagatggagagatttatttacacgaaaccctgactttttgagaagatttttgaatttattagaaatatggataatgctaatttggttgtctttaaacttatgtttggatttttgaaaaaaataagtacgtcttgtatcaagatttttctcattaaaatgatttttgtgtgctgtttggatagcctcgaactcttctgagttgataacaatttctctaatacaagttacatttcttttttttgccacatttacttttatgttgtataaagtttttccatttttgcttaaaaaagttgaaatatcttgcatttttactttttgcagttcggtgcccctgcagccacttattgcgagtaaatgtaaaaaccaaccagatattggatcagcttgtttaagagttttgatgcatttttcaattagtttgccaatttttggggtcaaataaaatttaggagttggctttgaagcttttttagtaggcttagaagaaatttttagtgaatttttaagaattttgttttcatttattagtttttgatgatcttgtaataatttaagcataaaatctatgttgaaattatttaaattaagataattattcatgtccataaaatcccctccttataagtgttacttttaaattaagtaaaagtaataaaaattgattaaaaatgtaatttatattttaccaaaaacaaaaaaatttagtcaaattgtgtggcttctcattgcatgcaaaatttggattgtaggatagctgtgataaacagaagaggcaatttttaaggggtgcacttaagaaagatactatactttaagtgatatatagcaaagactttgaaatttaagttgtatgtgttttgtagtcttttataatgagcaggccatttgcaatggagagattttagggagttgattaaaattatatttgcgttttgttaatatgtaatagctgaatgtaacaaaattatatatttaaatctttgaaaaattgtaattgtttggggttgtggtaaacttaaggcttatggagtggattatgaataaaaaaatgaaaatatttattatttgtgctgtatttgtgctgataagttcttgcaagattgatgcaactggtaaagatgcaactggtaaagatgcaactggtaaagatgcaactggtaaagatgcaactggtaaaaatgcagaacaaaatataaaagggaaagttcaaggatttttagaaaagattttagatccagtaaaggataaaattgcttcaaatggtccaatagcagatgaattggcaaaaaaattacaagaagaagaaaaggtaaataacggggaagaagaaaatgataaagctgtctttttaggagaagaatcaaaagaggatgaagaagaaaatgagcaagctgttaatttagaagaaaaaaatgcggaagaggataagaaagttgttaatttagaagagaaagaattagaagttaaaaaagagactgaagaagatgaagataaagaagaaatagagaaacaaaaacaagaagtggaaaaagcacaagaaagaaaacaacgacaagaagaaaagaaacgaaaaaaacaagaacagcaagaagaaaagaaacgaaaacgacaagaacaaagaaaagaaaggagagctaaaaacaaaattaaaaaacttgcggataaaatagatgagataagttggaatattgatggtatagaaagtcaaacaagtgtaaaaccgaaagcagttatagataaaattacggggcctgtatatgattattttaccgatgacaacaaaaaagctatatataaaacatggggagatttagaagatgaagaaggcgaaggattgggaaaattattgaaagaattgagtgatactagagatgagttaagaaccaaattaaataaagataataaaaaatattatgcccatgaaaatgagcctcctctaaaagaaaatgtagatgtcagcgaaattaaagaagatttagaaaaagtaaaatcaggattagaaaaggttaaagaatatcttaaagacaattctaaatttgaagaaattaaaggatacatcagttacagtcagtaattatattggatgcttttagatgtaactaaattttacgtacacaaaataacagctagtagaaaagttcactggctgttatttttttgtagatttcattgttatgaatatagaaatgttttctatcaaaactttcatttaaaaagtgcaaaaactattgctaaaaatgttgtttatttatatactctctagagctatgacgtatacaaatgagatttcagattttgatgataatttatataagaaaacaaaaaaagaaatagataaacttataaacaagctctatttaactagccaaataactctaaagcaaaaaagacaaatatacagtgctgttgaaagaatgcaaaaatacgtaataaaaaccggaaaaagtgttcttttagaatcggaaaaagaatttgttaaagacactttgaaaagaaaaaatctaataaaaaaatttaaaagttttaaagttgattttagctacaaggaaagaatgctagaaaaatgtttagaaagattaggagaagataaatccatcgaatttttgatttttgtttatcaaattcttaatgggataagagaaaaagtattagaattagactttcaaatagatgcgattgaagaatttagagatattttatttttgagtatacactattatgataaaagacttttcacaagtaaaaatcttatgaatgaaatgaaagatttttccgaaaaagtagaattattttatagtaatatgcaataaattaatgaactactatttctaaatcaaaaattatagaaatagcagcgaactaaatcaataaaggccaacaaatattccccgctaaatatcaagaagttatcagttaatgttaacaattaataaattgctttactacttagagtaacaatttgttaattttgttattttaggagaaattgttttgaaaaaagttaaaaggccttttgatgattatgttgtgtattttagagaaggatcgttaaatgatagagaaatagcgaaaaaattaggagtttctaaagtaaatgtgtggagaatgagacaaaagtgggaaagtggagaaagtattgttaaccaggacgctagagtaacaattagtgaagatactttagaacaccttttatcgcaaacctttagatcagaagttaacgctaggaaagttataagtgaattagatatagagtgtgctaatttaaaattaggatttatacgtgcatttaagcaatattctagtgttgaacttactggtatgcgaactaaaatagaaaatttaagagctgaaattgacgctttaaataaagcaagtagtaaaaaaaacaagcaatttgttaatggagaaattaattctttaaaaagcgagcttgatgaatatataaaggagtgttcaacaagagaaatggagctttactatgaatgtatgaaaaaacttacaactgctaatgaggctgaaagcaaaagcaactacaaaaatagcaaagggcacaagtgaacttatatcaaacaaaactttttacaatactacaaaaggaatacaaaaataaatatggagttgatatatcacaatttgtaaagctaacaaattcttcaattaattttgataagtttgaagaagagcagctaactttaaaacaaaaaaatgtgataaaaagcattaaaaagaataatgaaaaaaagattatactcagcggcggcatagctagcggcaaaacgtatcttgcatgttatctttttataaaaagtttaattgaaaataaaaagctatattctagcgatacgaataatttcattatagggaattcacaacgctcagttgaagttaatgttttggggcaatttgaaaagctatgcaaactgcttaaaattccttatattccaagacatacaaataattcatatattctgattgattcactgcgaattaatctacatggtggagataaggcaagtgattttgaaagatttaggggaagtaattcagcacttatttttgttaatgaggctacaactttacacaagcaaactttagaggaagtcttaaaaagattaagatgcgggcaagaaactattatttttgatactaatcctgatcatccagaacactattttaaaaccgattatattgataatatagcgacctttaagacatataattttacaacttatgataatgttctacttagtaaaggatttatcgaaacacaagaaaagctctataaagatataccatcatataaagcaagagttttgctaggggagtggatagcaagcaccgattcaatttttacacaaataaatattactaatgattatgtatttactagcccgatagcatatttagacccagcatttagtgttggcggggataacactgcattatgtgttatggagcgggttgatgataagtattatgcttttgtatttcaagaccaacgaccagccaatgacccgtatattatgaatatggttaagaccgttttagaaaattttaatgtacatacattttatttagaagatagagacaatacaaaaggtgctggtggattgacccgcgaatacatcttgctaagaaataatatgggtcaatattttagaattgttccagttaagccaaagtctaataaatttagcagaataacagcgttaattacgccgtttatttataagaaactgtacattacgaagtacagcagttcttctgtatttaatgatatttattcgtataaaggagataacaaaacccatgatgatgctcttgatgcaatatctgcagcatatttgatgttgtctttagggtatagagagagaagtgttcactttggcaatcaaagatttttgtaaattttattgacaaaaataatagtttttgctatcatacatctaatttaataaagagaagtaaaacggtgtgtgatttaagaaaaacaaaactaatagataaaataagttcactagaactatataaatactcaatattttttagaaattatatagaaaatgtagcagaagattgtctcaagaacggacttgttcttgagagttctgaccgcaatgttagtgaatttgaacttgctaggttaaaggtacaacttaaagatgctctgcttaattgtattataagctaccgttttcatgggattggctatgttttagtgaaaaccaaagataccctaatagatctcgaacagcccgttaatatagaattacctattggttttgaataccttgattatgaatatgtaagagatttgggagttgattttgatcatataacctataaagtaaaatccaataataaaaacaattctttagatgcagttaaaatacataaaagtcgacttatcatatatgaaaactttgattatatcttaaaaagatatgttccgtgctaaaccgaaagctttttgctagatatttatttatttgaaaagatatacgtagaaatagaaagacgtattgaaaaccacaattttttgttttacaaagatgaatctttagtacaactacaagacgcactgtctagcgcaacaacttctttaagtgcacttactcagagcaataatgataggggaagtggccttttatcttcttttttgagaaaacaaaattcaaacaatcatagtaaagatatttctaatttaagaacccttaatgactcattatcacaggagcttgctaggctaaaaagcaatctaaataatgagggaatgttttatacggccacccctagtgctagtttagaggttattaaatacgaccttagttacttaaaaaggaggctttagcattaattaaggcaaaaattggtgcagatactaaagaacccttaaccagaagtattaatgagcaggctaaagggctaggaaatgatggtaaaggggataggagtaattattacgattttctcaaaggtgtacaagaacaagttgagaactcttgtaatttaaaacttacaaagtattttgggcttgatatgaaatttaattcgctgattatgttaagtgaagaacaaaaagtggaaagagatataaagctaattgagctttacagtaaatataaccagcttatacaaagtagctcctttgataatgaggagttagcgattttaaaagagaaattattctcattttgagaaaaggagttaaaagatgcctgagaaagaagaaaaagaagacctgcaagcacaagataaagaagagcagcaaaataaggctgatactaaagttataagtgcgcaggaatttgaagagtacatgcgttttaaagagcaggcaaatagtaaatctaaagagacaagtcgagatttaagtataaatgaacgaataacaaaagaacttacagaagttgaagagcgggagcgtattgaaaagcaattgttactagaggctgagcgaattaatgaaattgatacacttgcaaaaacacatcttagcaatcattttaacaaagaggtgctacttgcaaaaggacatacattaaaagacattatgcaagcacaacgtagagaacttgtacgcaagttcgttccaattgagcaaattaaagctattgccaaagtatcagacataagtcatatcgatggagagatattagagcaacttgtttctttagcaaaagtgaatattaaattaagaaaaaatgcgagtagcaattcttcttctgttgactctattaaggggaatattgctattaagtcagaagaaagagcaagtttgcttaattctaattttgtgcctattaatttcacagaatttgtacaagcgataagtaatacttacaagcaaagacgaattcaattttatgaaaatctaaaaagacataaaagaacaagtattgcttaaaggagtttttaatgagcgatggtattacaaaaataaaagaagagtttgataaaaaagttgcagaaattaaagcattaatgaaaaatcctcagcaagatgctggtttgcttagtaattctatagattttagagataaaaatctaatttactccaattcggatggagtttttactagtagtaaagacaaaatagaaaattatcctgctaaagggtatccatacaagcgtggcgtcaagcttagttttagtgcagatggtacaacagaactagaagttgaggctggtggtggggatgacttgtacggaatatgcactgatatagatgagtttactggcatggcaactgtagttccaattacaaataacttcacagggtatttaacatttaagaaaaatggacaaaatggtgtgaatccgggtgataagctgcattttaatgcacaaggagagcttgaaaagaatgggggaaatgataaatctgttaatgctatagcactttcaaaagtacataaattaactgaagagttatctatagtgcttgctagtgtttttgggaatagagctttaaaaggtaattaaattatggctttaaaaggcaaagggcaagctaaatctcctaatgttgatgataatccacaattagggttagaatcagaaattccagctgctcctagatctaaacgtcaaacaagacaggctgaagaagtacaagcaaaagatccttatttagattcagttaaagaacttgacgatgttcttttaaaatttaaaaaatattcaaaatcaatgagttcgattgaaaatagggtttttagtagttcgggtggttgttttaaattaaagaatgagcgagttaatgcttattcttttacatgttcaagctttgcagacaaaatagaagaatacctttatgatccagcaaatagttttccatataagcgtggggttaaacttgttccaaaagagaactctatatatgttgaagttggtgctgatactgatatgtatgggatatgtgtagatgtatgtgagtttagtagtactgcgtatgtattaccaattacgaataactttgaagggtatcttgttacaagaaatccgagtataaaaatgggagaaatattggataaaagtgcattttttagagttttttctggagattgtgtacatgctacgattttttttatcttttcaaaaagagaatttcttgaattcttattattattttttattaattttttattatatacagtgacatttttagactttaatttttctttatttgattttatttttttggataactcaagcttgatactagaaaaataagtatcaattattgagtatgaaattctagaagtttggtatatacaaagcttgcctttaaattgtcctatgttatttgaaaatgttagaatttttttattaattgctttaattttaattaaaaatcttaaatcttctcgtaatgtacgaattgtagttggcttatacccttctttgattataaatgaatttagtatatttaatatgtcttgttggtggtgtataagaatacaaagtgcagtatttgtaatatcttctttatgaagattaatattacaattttcttcgaactttttatttagaaaatttattatgctgattatttttttaagcctaaggttttttgataataaccttttagttttataacaataattattgttatagagatataactgatatcatattgaatctccaatttatcgtttattcaaacttttttattaatccttattaataaaactattatagtttaaatggtgcataattttcaacattttggctcgaagattttttaaaaaagtgttgtgattttcctagtagagtaaaagaccattagcttttgctaatggtcttttacaaggtattgatagttcataatttattatgtaactatcaatacaaatgttatatgctaaaaaatataaaatatcaagaaatatgaaaaaaattttcatatttctctattctgccattctaaatgtcattaaatgttcttttgattttagcattctaactaatttttcagcatcaagcacatctccataaaagttgtagtaaaaattatttacaactgtactgctttgggtcttttgtaatttagtaatttcttctgaaataattttagcttcaagtttgcataaatttgcatctattggtgcaggagttattcttaccaattcgggttgcccaaactcactagacattacacctaagtttggtatatatgtcggtttatttgaaacaaatcgttcacaaccatgagcaagtgttatctcttcaatagatccagctgattttactgttgcaattctttttagtatttcgtctaaaattttttgcatctttcttaacctatcggccttgcccaaattccaccaattttcatcatttaccttatcaacttcggcctgtgcttttattcgttcgggctctggtttagaaagtttgtttttgcgttctacttctaggtttttagtctcttcggtcttagtaagttgggtggtttctatatctttttttgttttatattgtgtttgtacatcgtgtaatcttttttgaaattattcaccagatatttgtcctttactttgagcctgtttgagaaattttatttctttagtgtatacatcatctaattcgctcaatttttcttttttcattttgatttctgcatcaaaacgatcttcaagcttttgaagttaaacttcacttagttttttaagttcctccaaatcttagtcccgtttttttcaactgctttaattctcgctttttcatgccctttgaaaattccccaaataaaatcggtcaatgctgttataagttctgcaacagcttctccccaaggtccaagaattttttcagcggcttttaacccacttttccaagtttcgtacatttgttttgacattttttccaaaacttcaccccaatgcccatcatgaattgcttctccaatactttctcccatatcctgattcaaaaaattacagctgaccgatagatctttcataaaggcctttaggccgtctaacatgcggtcatataagctttttgacgtatctttagctttctcagccatttgttttagagagtttctgatggtttcatttagcttttcgaattgcgatttgtgctcattcacgaattttttgtacattaattgaatgtcggatgccatcttttcttcagcacttgctctttcttttgctggaagtaacattgttttctactctaagtcggttatttcttttttgcagagctttttgagcctcgacaaaagatcgatctaaagaggttttttcaaattccttaacctgattttcaagtgcgattacaacttgcctgttagactcgttcagagtttcgaaactttttccatatttttctacgaacgctttgttcttttcattgatttcatcattcagtttctgtaaagcactttcttcatctatatggggtagggttaatcgtatttttctttcacgactttctttttcttttagatagatactagtctatttttatctagatttacccccccaaaaaaagcaaatttacttttgtatttttgtgcttttgtattgttaataatttgacctgtacatcgatttcttttatttaccatttgcttgtacgctgtaagttcttgtactagaaaactgatattgtctatttgcgaatcaaggtctccttcctagtcaattttgaacttaatgttgtactttttttcattgcatccaaaaatgcaagcttagcgtcttttacactcagaatatttgcaaaaggtggagcaatttcatactgctcacaagctttctcaaaatttgacaaaattttggaatctttgaaagcattaacctcggtttgcctttcggcttgttttcaagctttcgtaaagttactctcagcctcagcaagtcgtttttcaaaatcttctcgtgatatcatgtctggcaatttttttcatcagccactaaccgttcatattcttctgaagatattgttacaagttctttgtcattttttggcaaagattcaggaattgtaacagtttcttcatttatttgttcttgcatattgccctccttaaaattaaattttctaaatttgcaagtactgattcatttcatcttgtatttttaaatacaaactatcatttcccatttcttttgctttacttaaaagctccacataagttgctaaggtttttgcatgtttttcatcaattttggcttgttctttttgactaattggttttactggtttgtaacaccaattagagctcaatccaaattttgaaagtaccgcattaatgaatggcggtaccattagtttgcatatctgttaaatgtttagatatgataaataaatcaagtgataaatatatgtttttctttgccaataaagtattagacgcgcttaaaatagaacgaatgaaagtatctataaagacaatagaatgtattttctagaaccttcacaaagtattaatcttatagaaaagaaagaaagtacaaaaaaagaaaatagaattataatatcacttggcgtgtagtgatattataattctatttatatttattcattaaattctttaagattttgtattatttcgtcaatttctttttgtacattaattgtatagctaagcacttttataactttctcaagatgttcaatttcgtcttcattttcattaataataagttctttcccttttctgtactttaagtaacttttaagcacttgataacttccaattttgtattcatatacttctttagctacattagtaaaacaacatgttgaattatagtaaagttcttttgtgtcttctttataagtaattttctctacaatacgattatagtctccagtgtgattaccaatactattgttgagctttaaattatcttttaataaatgagaattaatgagtttagttccaagcttactaagctctaaaaatgcatctacattatttacaaaaataatcttaggatagtctatttttaaaaattcgtagaatttttctctataagtatttgagtatagcactgcatagatataaccaaatatttcttctggagtaaatattttactgtatttagtattaataaattctctaaaaatatctttattgtccttttcatccttcttaaagttttctttttttatatttttaaatacaccttgattttcttttatataaagtggaaaaagatagcatgattcactacctttatttgaaacaaaacatttatccgaaatttcagaagtaaccaaagcatgtttaaaactatttgttgataaaagccttgttgtaacaagtcctatattgccttcaatttctaaaatatgtttcattgttttatatcttggctctactacaacccctttatttttagaataataagtaaatctattatcaaatggtctatatgatatttctttaacataacttttattaaaattggtattttttaaaaatttttgaatttctgataacttccaaaacatagaatctttttctatatcatatttgttccttgcatcttgttctggtaaatatgcaaaatccctaagtttatccataaggttatcttttgtataatcaatcgctattttgtcttttctagttactattccaacattaaattcattaaaaatatctattaaagattttcctttattataaatatcttcatttgataaatcttttttaagaaaaaaataattaggctctttatagtcaagtttttcaaaattaagatcataaatatgatttttatttaaaaaatcatatttatgatctctttttccttttatactgctgtagtatacattagccagttcattctttttttctttttctttatatttagcaaaaatagcaattgcaaccccagtttgaatgtcaaatacattttcatctatactaccatcgtcagttttttcttttttacgcgaactaccatgtagattaaggatgtagatttcatcaaaagtgcttagcaaatgatgtctcatgcctctgaatgtgatgttatcaaggtatccattgtttgttataattccaagaagtccttcttcactgcctttaatagttaacaatccttcttttttattgctctctaatttattctctgcaaatctaataaacttaacataatcatcattaagtgttttagtatttctttcatttataggactattttttatttttttataatcattaactaaattcaatatatattgattattattttttgactctgcactataaggaggatttccaagtattactagtattggattacgtttaatttcatttgcttctttcgtctcttttgcaatatctttaaaaaaagaaaaagaaaagaatttctgatctgtaatttcttttaagtcaagagtgttagttaagtacactttgagctttgaatccttattaaagtcaactttgcaaacttcttttaaatactgacttaatttaaggtgtgttacagcataaggtgccattaaatattcaaaaccatataagtttttaagtatatgtagattaatatagtctttttgtctaccagattcctctgggatttcctttagtattatagtacgaataacttcaagtaaaaatgtacctgttcctgttgcaaagtccagtactgtaactttttctttatttgcaaggccatgatttaacttaaattcttttttaagcatttcatttaaactactaacaataaaactaacaatagggctaggggtgtagtaaactccttttgccttccttaaggatacatcgtatttagcaagaaaatcttcataaaaataaagatagggatcctttaaatttaagctagaattagtaaatgaaaattcattaaaaataagttttgtatcaatattatttactatgcttataatactttctaaaatccatcttaagtaattaaattcactatctttatggatatctttaattagttttataatgttttgtataagtgaaaaattagtaggtataaagttttcaatatttttaaaattaatttctatattttctttactattaagacgagcaataaaaagtccatatgtaatagtttgagcgattgaatctgaaaattctgaaatattaaaatcatcgctataaatactttttttaagtattctacaagttgaaactaaaacatttagctcacctagttctgattcatcaatatctaaatttagtttttctttattttcctttaagtttacttcaatctcttcttttaaagatttagttttacttgcaagtaggctagctaaagcttcaatactttttattttttcaaaatgagagttaaagaactcaaataaaatatttataattttggttaatttatttttatcgagtttggtatcttcactatatagctcttctttagttagtaaagaccctcttagtttaatctctttgtctttaatccatataaactcaatataatttgtaagaagtatactgcgtgttatatttttgtatttttcaatttgggaactttttagtatttcgtctaagttttgctcaacttttttaacttcaatacaccctatagtaccctgggttatattatgtctaacaatatagtcgggtgatccaaatccttctttgcttcgtcttggctcatgctgaatagcaatgcttgaattttgattaattttattaaaatcattaagtaaattttctaaatgagttctgttagaatactctgttttttcttctaattttgtactttttagattagctatatattcttttgcctttttaaatagagattcattattattcatttttataaatataaaagatatatagtttaatatcaactaaactatatatttgaaaaaactatttttgttcttagcatataacaaaaataaaactttctaagtttcgatatattgctttcatgtcagaatttaatttttcaaatgtttttaaattttcagttttaatattattgctattgctactatttatagtaaattctttattatttttttattgtctaataacacgattttttcattaaacatactaaaagagtttttaataatattcttaaatatttcatctgaatttttcgtatcaaagttaattttagttttaaaaaatttaagaaactcatcgcttgtattcttaatctcttttttaaataaactaaaaatttgtctgtatattttttctctaatgtaaaagatctagcttcttcaatatttaaagaatttctagaaaattttttaagatattcaaaatcttcagatgttaatttctctaaattaataatcataaaaggctcattgtctagtgaattatctttatccaaatggcatagaatatagattctatgccatttggtaatatgcccaatttaattgcatatttagaaagaagattataaaaataatctgataattgactaaaatgattttcaagattttctttatgatgcttaacttctaaaaaatagtaggatttttatccttagaataaagaacatagatcgcttttatttcattttttctagtaacaataattgaaacttcaacttaaacacatgaaggattagtatgacaataactcattgcatctaaaaatgggtcaataaaaaacggtcttttttttagcttctattttaagaccatccttatgagtttgtatttttttacttacaatacattgatataaaaatttacctaatttcattattaatatatttagtagcgtttttaattacaattttttatatacctaatgataaaaatacagatcataatcatagtaaagaagatttaagtttatatattatgaagtttaaaaaaattgtaacaacattattacaatctaaagaacttttagaattatttattttaattggctttattcaatttttttatcaacctttttatttaaattggcaagcaatttttattgacaaaaccatatctattagtatatttggaattatctatgtgctatttagtttatcagatattgtgggggcatgggtatttagaagaattaaacatacaaaatatgatatttatatcatattaaccataatattgttgttataagctttaataaaaatagtttcacatatttatatatttattgctgtaatcacatttttagtaattttaattgctatttattctaacaatttagaatattttttaaggaaaaatatagattcaaaggttttaggaaccataacttctattaatagtgtaatatcccgcatattttcatttttagcattggctatatgtttgaatttaactaattttataagcgctataaatacatttgttttattaatacttattttttgtacattatctattattgtggtgattgcgcaaactataatttaatttttaaaaatatttaacctatagcttaatatgacgttagatggatttaatttaattaaattcgagttaaatgtgctttttattatccccgtgaaaaccctttcagcagaaataatacaagaatttttaagccaaaaagaatattaatactgatgcttactcaaatagataaaatatttttctacataaacttaaatatcatatttttaatttttttaattaacttaaaaagttaaacccaagggctatatgttgacactataaatgcagatttcttgcttctgcagatagttgtttaaatcatcggcaagtttacttacataggatttaagctcattgatatctgtttatataagatctttattgttttcacaatctaattgtttttttgtttttgtaattaaaattcaatatttttgattaaaggaatgttaacaggggctaataaaaaagtttattagccccttatatctaaaggtttaatttactttaagcccctgcattaataaattttaatttataatgctgaaacagttattgataatataatttttttcaaatttccaacctctttaattttttcattaaactgattaagtattgtattaagataagaatctaatttagaataatccttttttatagaaccggtattattttgatgatctaataaagtttttcttatgcttattgaaaaaaattccttatagagagtaattattcaagagagtttttgatcttttccaaatctaaggtgtttaccttatctaagacatctttttttgagtctaagtaattaattgtctcttccagattaagctctaaaattgctatgttatttaacatcttgcttggtgattgttttggtttatttaatattgttgcaaatatattgaactcagcatttgttaaaaaactatttataaagtcataagtttttttatttatatcaaaaacttcctcccagtttttattatctacaggttcttgatctgttggctcagtttgttgcagtgttcgtttctcgatgatttctttacttgctgctattaaatttttatctcattaatatattaggtttttgttttatcaacaatttttgtttcagtgtcatggttgcagcacagcagcttaaaagtaaaaaaacacagatacagaaaatcattttgtttttcataaaaatattctccccaattggtataattaattgtgctcttataatagagaatacataagcttgatagaacaataagatgcttttatgagattaaataagcaatttttgataataaaagtgcggtattataggctttttatattttataaattttaatatattttttaaagttttaaaaaactttatctaaaaaataagatcctatctatattgttgggattaaatttgtattattttggggttttatactaataaacattaataatggtgcttgtctttttttatatatatgataaacttttcaagaaaatcttaaaattttttataattatcaactttataaagtttttgttattttttgtataaaattctagcagttcaattttattatttatgtcactacagcaattttttgtaactaatttttacatctttaatattttattagataatattctcaatattataaataagtttattgttatttatgattgaaaatcaaaaaaacatgaaaaacaaaaatgcttttaaaaacacagagaattaaattagataagtgggggaaatatattgaagggaaattttatttttataataaagtaaatggtatgtacaaataatttacaagaatttaaaccaatatcaaataactttgttatcaagaatgcttgggggaacctaaaataatatattattaggtttttgattttttgtttaatatataataaaaatacagtagtagagaaagttgcttataataaatattgcattttagtagcagggcagcacttggacattgacaatagagagcttatcaattaagggtatttaaaaatgaatgtttggggaaaagtattaatgattcgatatgttgttaatttggaaggcaattatcatataaatcagggtggcactaatcttctttgcataaaatagatagatttttttcataaagtaaactatatagcaattgtaatattaaaaatataattctaaaatcgatcaatactattgtagatctatgagtaattataatcgatttgtatgatagaaatataaaatgcaactctaaattctaagttttcttcttataaaaaaaataaaaactaaggtaaaaattgtctgaagtaaagctttatggaactatgtccactgttagattgctgtttttatgttagagcttaaaaagctatcatgtgattgaggtaataagctatttcgataattattgattgttgaaatagcagtttttataacgctaggcctatcttttattaaagataggcctttgcattatgacaatttcaatatatagcatataaattaaaggttttctattgaatatatgtcattttttagcttttctgattcttcgattttttttgtcagttgattaaaaagtgtgtttgcatgagatttaagtgcatttgcatctgtttgtatactatttgcattatttttatagtctaataagaacttgtataacatttccgaagtgattttttttatctctaaaaaattttccaaagaatctttaagcttttttaaggccgggatctctaatttttctagattatcttttttaggatacagaaaatcaactatatcttcaaaggcacctccaagtgagtcgagattgttaagtattccttgtgtttggcctgatgccattacaatttctgaaaaattctttaaggcatcattatcgatagcatttaagatactataagttcgttttctataggctttagatctttcggtgtttgcagataactgttcagttccgtctggctagaacaactctttgaaagccagtattccatattgatttgaagattcttcttttaatttttgtacatatttatcattatccgatttagcttgttctattaaattttttaaatcatcaagcagtgtgttttctgtttggttattaatgtctttttcttttttggagattgcttcttgattttagctttctttttgatttgagcttgcttctgctataggggttaatccctttttattggattttagtctttttttattagattttagtccttttttactagattggtacttcatatctttttgattagtgttaaaatctggattacaagctaaaaataaaaaaacaaataagcttacaataatgttatatttcataaatattctccttaattaaaatctaaaatttataaaccaatattaaatataaaccaatattaaatataatatatatatttaatcaaatgtagaatagtaaaatattggaagatttatatcaatatttttattgtgagaaggtttatattatttttatatctgttaataattttttttattaagcgtaattattatacttttacataaatatttaatttctatagaattaatagaatgctttgatatttacaaatattgagaaaagataaaattggtgtaaacttgtacattatgcttattaattctagtgtaatctatcttattaatagaactttttaagtttagcaagaatagtgctttgataaacttttatagtttattttagctttatattggcaaagagtatatatgaaaactttgtaaagatcctatttccaaagttacaattgcattcaaaatgaatggtagagaattacggttgctttttagttttcatgtttcaatgtgtttgtaatatgtccgacatctttttcaagtttatcttgtgcaaagattttcattattaaactaaaaattcatattaatatgaaagttttttttatattaatataacctcctaataattaatttttgataataaaatattagcacaatttttaaattttatttttagagttgaatcttttcttaagatattgtatgaattactttgctgtgctaagtagattttaatgtagagtttgtagagttttcattaaactttagccttaaaactttcaccatgttgaattcatttttaagtagggaaatattatctttttgaatttccaaaagctttttagtttttttaccattttcattaattatctcattaatagtaatttttctatcaacttgtttttctattttcaagataatttgaatataatataattaggggagttaaagggcggattagatgaattagcactagcaatggttcgtgtatcttttaatgcttgaatttcgcttgacaattgaatgtctttttgagagctaaattttaggtattttactattttaatagtttattgttgttatttatatttgtagtgatgttaatttcgaatattattagattaatatttagatttttttgttttgatttatattgattttaaccaatatgtttataacaaatttcttttttaaaaaaattttaaatcttatatataatattattaatttaattgtaataaacacaccagtgttttgttgattatttattaggtctacgatacgctagtaggcctaaaatttatataaattttcttttgtttgagatatatatattgatttatataaatgatttattttaataatttatgttttattttgtttagggcgctatagtattatatgccataatacatttaaaatatatctgaatttttcttttaatttagtttatttaatttcaattaaatgattttgatataatattttctaatattcaataatttttaaaggcatttatagaaattattttaaccaattgctttaagtgcccattattttagtattgattttcataatatagcgagggtttagttttgtaatatagtaagcttattattatctttattgggcctattataggccataatacactaggatagatattggtttactatttatataatcgatttatagtaaattttctggattatattagcttactaaaggcctctaaagctttcattttctttatttgtggaacatttgaagattacttttggattttttctaatatttcaagatattctaacagggttttagaatcaacttcatgttgattagttttagctagagccttattaaacttgcttcttattaaggaataagcataatttttatttgcactatggaataattttttattcatatgatctagtgttttgacaagaatgattaacttattcttagcaaattaaatttgctttgttattcttgccaatgtattgttaattactccatccataatgaattagccccctattatattaaatttatattataaatatagcacagtatttttttaaatttttttagcgtaaaacaatatatttctaaagttttgcataagcttattttataatgtatttataattaagtagtagtgattttttgtaaaaattgttttaattcttcatagaataatacgtagtagtcttttatttttaataaaactctttctaaggagcaattaactttataataaattatagatttaggatttttcttaaaataaagtttgactatgacggttatttctttttctaatttgcgttttatttatatattttttagttttaattgttctttattaggcctatgagacactataatgcatttgcaatacctgattttttatattaatttgggatatataatttaaaatatggtatcacccccattatacaccttaaaacaactttagattaaggggagaaacacctttagtaatatactaaagatgtttctctttttaatatcattatatagtctatttatagtagttcataatttttgtgtaacatatttttaaaggataattgattatgtagtaaagtttgaatatatttttttctactttatatttattagttataatttttaggttgttttctaaaaaatcgagatactttattaataagtctatgtctatttcaatatctttactagtattgcaatatctatctatgttaaaagtaaacgcacggcgtataaagcccctactatagtatccaatattttttgaatttaggtcaatgttgtttagtgtgtaaataagaattattaagtgtgaagatagcctatttttgctattcatacttaatatttcttttaaaaatttttccaaatagtgccccagtaatttttattatttatcaaataaaaatatatgtctttacatttatatttctaaattgcttaatttgcaaagaaatattttttacgattaaatagtagtaggatagtttagttctaaccgtagttttagtttatctgctattgtttgatagtagtcttgtattgttgaacgaaacactttaagggggattaattttataataaatcatatatttggactggtttttaaaagatagttttactatggtttttgttttttctaatatatcaagatatttattcattgttggtagatcgcaagaatttttattatcttttttaagaatttcgttgtaaaattttaatagtttttttgagaataattattcaattctagatttaataatgtattgtcacataaagcaggcataccccagtaaactcaatttctaattgatggagttgtttttctatttctgattggttatttattatttctaattgtgttttttctatttctgagcacttgtttttttgattttttttcataatattatagtatataaaaaaaatagtattaaaattgtcaagaatattggtaatttataaagattttttataagttgctaataattcttaacaaattgtctccatttattatgtagttggtatagtaataactactactactatcagcattattgttaatgctaggcatgattaaatgtatgtattctttaaaatcgtcgacatgaatatgcgagtctttgttgttttctttttgggtttgattttctctaacatctttagccctaaaacttcctccatattgaattgcatctttaagtcgagaaatattcccatttggaatttctaaaagctttttagtttctgtgccactttctttagtcatcccattaataataatatttccgtcaacttgtttttctatttttaagatagtttgaatataaggtgggtagttaatagtagaattaatattatcattttggttagtaataatggttgaacgtgtatcttttaacgcttgaatttcgtttgaaaattgaatatttgtttgacgactcatttatttgatattcgcttattttttctttatttgacatgtttagtggattattttgatcagaattacttaaattacatgaaaagactaataaaataatgaatatcaataatttgttcatggatattatagctcctattaaacttgcaaaaaccgcttataatattatagatcaggtttattgataatcaataaacctgatcaacgattattctaatcgttttaaaaaaaacaagagaataaaattgcaaaaattaaagttttatcattttgaaaaattctagttaaagttttattatttcgggttaaagtttagtattttcaagttaaagttagcaatttaaagggtaaagttttgagtcaaag

SEQ ID NO: 212 - protein, 393 aa, Borrelia burgdorferi
MSIKTVKDFSSFAGKRALVRCDFNVPLKEGSISDDTRIRAALSTIEYLKERGARIVLVSHLGRPDGKKNPKYSLKPVANRLSELLGQDVKMLSDCIGSEVVNSTLQMKDGDVVLLENVRFYAEEEKNDKNFAKKLSENGDVFVNDAFGAAHRAHASTVGVADYLPSVGGFLMEKEDKFLGGILKNPERPFVSIIGGSKVSSKIAVLESLLSKSNVVVIGGGMAYTFLHSEGYSIGKSLLEDEYIGIASSFLKKAKELGVKVILPLDHIVADDFNKNSIPEYIDSFNIPENKIGMDIGANTLKEIENVVKTAKTIIWNGPLGVFEFDSFSKGTAKVAEMVASCSGLTVVGGGDSVAAVNKFNLSDKITHVSTGGGASLEYLEGRILPGIKVLEN

SEQ ID NO: 213 - protein, 336 aa, Borrelia burgdorferi
MKSFLFWVILGTVGISSFAQNTPVAIINLYKNEIITKTGFDSKVDIFKKTQGRDLTDAEKKQVLQVLIADVLFSQEASKQGIKISDDEVMQTIRTQFGLVNFTDEQIKQMIEKQGTNWGELLSSMKRSLSSQKLVLKQAQPKFSEIKTPSEKEIVEYYEANKTKFVNPDISRVSHIFFSTKDKKRSDVLDQAKNILSQIRSKKITFEEAVRKYSNDESSKAKNGDLGFLSRGDQNAQNLLGADFVKEVFNFNKGDISSPIASKEGFHIVKVTEKYAQRFLGLNDKVSPTADLIVKDAIRNNMINVQQQQIVVQVQQDMYGKLNKSANIQILDSSLK

SEQ ID NO: 214 - protein, 627 aa, Borrelia burgdorferi
MDSTFSGIEIGKRSLFAHKDAMNTVGHNLSNATKPGYSRQRVTMKTEIPLYAPQLNRAKKQGQLGQGIVVQSIDRVKDELLNTRIIEESHRLGYWTSQDKFISILEDVYNEPEDQSIRKRLNDFWESWHDLANQPQGLAERKIILERGKSFCEGIRNRFHSLERIYIMANDEIKITTDEANNYIRNIANLNKQISKSQAMKDNPNDLMDARDLMVEKLGNIISVSIENKQDPNEFLIHAEGRHLVQGSIANEFKLEATNGPTRTRWNILWANNDKAYLKTGKLGSLLNIRDEEIKNEINELNNIAANIIEIVNEIHEAGRGMDKKNGRSFFSQELKLTDDRGRYDTNGNGQFDSVHIFKINSTNEIFPEEKLGFYGTLKFEATNSNEIVEIPYNAPDTVQDVINRINNSNAQVTARINSEGKLEIKAVKEQEDENITFKIKHIEDSGSFLTKYTGILNASGPEGAYDYKNIDTTDKLAPKSTYSISPLKNPAAWIKVADIIDSDPSKIASGIKNPTNEISIGDNQAALRISSFGNSQIMIGKNLTLNDYFANTASNIAIKGQISEITKESQSQILKDLTDLRMSISGVNKDEELANMIEFQQAFIAASKFITVSVELIDTVINKMGV

SEQ ID NO: 215 - protein, 280 aa, Borrelia burgdorferi
MMKKVIILIFMLSTSLLYNCKNQDNEKIVSIGGSTTVSPILDEMILRYNKINNNTKVTYDAQGSSVGINGLFNKIYKIAISSRDLTKEEIEQGAKETVFAYDALIFITSPEIKITNITEENLAKILNGEIQNWKQVGGPDAKINFINRDSSSGSYSSIKDLLLNKIFKTHEEAQFRQDGIVVKSNGEVIEKTSLTPHSIGYIGLGYAKNSIEKGLNILSVNSTYPTKETINSNKYTIKRNLIIVTNNKYEDKSVTQFIDFMTSSTGQDIVEEQGFLGIKT

SEQ ID NO: 216 - protein, 262 aa, Borrelia burgdorferi
MLMEVLMRRLFLLYILCSFVFLNLFAQGSSSYIDKQKELAIFYYEVGQRYINVGKIKKGKLFQAKALKIYPDLKKGFDIKLAVKELDARIKDDNPKVVMLEDIKLEEIPGIVHEKIEINDFTNAPKIEYIAQRERSKNQDKIIKFQFGKFARALISRNFDLFDSVIADKVNVMGQFESKNDFISTLSSASSKADADELEYLSVDDYYDLKSLKISKSNDTSFAVNVNAKKNDVTKNFPFWKERQTLIFTTEDDNNWFLSSIN

SEQ ID NO: 217 - protein, 337 aa, Borrelia burgdorferi
MKGFLAIKLSNNEYYPVLNLDDSSVKRIILGKVAGDTSIKLNLYVSEYEDFLDPFLVGSFFLDNLKKESLSVNVYFKVVDEILYVYGESDGIQDKSKFDLSLVDFNQNLKGSNRGNPLNDFKSDIGSDLSVENLGSEFDLNFEEKDDFVKKDVSDVSMPTINSLDLKTEEDQKIETNVSDFEDFDDNYDDSLVDSKKLNLENKKVEYIDEKSLNLNNFEFQKLEESSLEEEDLHDLSVEDIIADIDKELIDTSDEDVELDLREDFENDMVKNNFKLNSSEGMVHSPMLYLSLISLFLLIFFSLFLVFSKILKPRDFVSYYFEYDKNRIKRYEKDQYV

SEQ ID NO: 218 - protein, 178 aa, Borrelia burgdorferi
MPNKDDDNLDMGDSNVSRKGGLLPDIIIKILQILAIGIFTVAIMIIVSYFVSKMVVSQSGAPSDFPVFSNEYLGKPPMLIWYESIDEIRGNTLDVPPKTFVVKLALGYAENNVNILNELGRQKVRLKDIIREYFSQRTGQEIKNESQIKAEIKARINSILRNGEIKEIALTQIDIFDM

SEQ ID NO: 219 - protein, 207 aa, Borrelia burgdorferi
MKVNNFLSFFFRAFFLLFLIVILFFFVLFFIDFIGMYNTKRYFPEFVRTKLLGETSLVFDHNSNIILDEARLVKEREAIDIKNQQIEKLKEDLKLKEDSLNKLEFELKQKQKDLDLKQKIIDDIINKYNDEEANILQTAVYLMNMPPEDAVKRLEDLNPELAISYMRKIEELSKKEGRLSIVPYWLSLMDSKKAAILIRKMSVSSLE

SEQ ID NO: 220 - protein, 377 aa, Borrelia burgdorferi
MNIKNKLISLLIVVAISFIACKTPPESRESKNAKIAQPDNKNFQLRDIKDIKNELIRERGHLFYSKEFNEAERLEEAMKQSFSKKKAIEGNEIALKVLERYKTIIRETREKKEKTNYLKENIEKYLNDAEANEAYIWIPLEIDEVNNLYFEATRKYKNYDLDNALDMYSKAFNRAQQAAKNAKEAKALKETDERMYKQLKALEAASNLPIYSNNKLIKPSPWNGRAFIKERNSHLNLLNTNKDTYLLGEAEISIPIVLAYEEKVEIAKNSKPQEQFKTLELIERSRTLWEKGVEAKNVKNFRLANELFLESARYLEAYQSNASSELYVIKIGNTLWGISKKLYNDPYLWPKIWFANRQKIQNPDLIHSNWKIIIPAK

SEQ ID NO: 221 - protein, 433 aa, Borrelia burgdorferi [sequence omitted]

SEQ ID NO: 222 - protein, 477 aa, Borrelia burgdorferi
MISKLTKIVATISDLRCEPEHIKDLHDAGVNVIRLNTAHQSHEDTIKVIDNVRKISNKIALMIDTKGPEVRTANIENPIIVKTGDKVIISTSPINEPNNFQTNYDGFVKEVPQGSKVLIDDGELEMTVVAKLPDRLICEIKNDGQIKNKKSINTPGISLKLQSVTEKDKGFIELAAKYNVDFIAHSFVRHSKDVQDVQEILTASGNPDVKIISKIENQEGIDNIEEIAKASYGIMVARGDMGVEIPAEDVPIAQLKITQTCIKYGIPVITATQMLHTMIENPRPTRAEVSDIANAILNGTDAIMLSGETAYGKYPIEAVKMMTSIAKKVEKHRKMTLYKDELFYDKSITRNYIIKCAIDATKLMDIKAIIVDSLKGKTARIMATYRASVPLFITTNSERLARELALSYGVYSNLVDNNFKRTTEFVVTSLKMLKEQGVVNDKDTVIIISGNPNRNIEKGTEFMEINTVEDAIKGRNI

SEQ ID NO: 223 - protein, 475 aa, Borrelia burgdorferi
MKNKFLICVYFLLTLGISSLVIVESIFAFDESNNKLSRSNYEQMMIQAFEFVKENYVDPVSDEVIFEGALKGIFQSLGDPYSQYLTKKDLEEISKTTVGDYVGIGISIIKKMHSQDKQDKAKDFDPNSACVSIVTPFEGGPAYKAGIKSGDCITAVDGKSVYSMEVDQVVDLLKGKEGTKVKVSILRGKNLTLDFELTREKIEIQTIKYDVINSDIGYIRIVSFNPHTSVDFRKALDNLKNKNIKSLILDLRLNTGGYFQAAIKMADDILSKGIIVSTKSRNSSKPIDYKASSKQVLPSNIKIVALIDRSSASASEVFVGALKDNKRAYIIGEKSYGKGLIQHVVPFYTGGFKITSSKYYTPSGKSIHKVGIEPDLEIKSPDFSEEEALIYKEIFDKKLIEGFLKGKKFITEQEIDFFVENLVKENPKYKIDKEFLGKYVFFNYYQDNNKELPIYNLHYDKVLKTACEYLSKLGN

SEQ ID NO: 224 - protein, 360 aa, Borrelia burgdorferi
MYYEIYFLYFFIKSKEDIFMLKKVYYFLIFLFIVACSSSDDGKSEAKTVSLIVDGAFDDKGFNESSSKAIRKLKADLNINIIEKASTGNSYLGDIANLEDGNSNLIWGIGFRLSDILFQRASENVSVNYAIIEGVYDEIQIPKNLLNISFRSEEVAFLAGYFASKASKTGKIGFVGGVRGKVLESFMYGYEAGAKYANSNIKVVSQYVGTFGDFGLGRSTASNMYRDGVDIIFAAAGLSGIGVIEAAKELGPDHYIIGVDQDQSYLAPNNVIVSAVKKVDSLMYSLTKKYLETGVLDGGKTMFLGLKEDGLGLVLNENLKSNYSEIYNKSLKIGQSIMNGIIKVPYDKVSYDNFVLQMEN

SEQ ID NO: 225 - protein, 625 aa, Borrelia burgdorferi
MFFNFLKKDLVFVLPEVNSKEDVIDFLIEKINDKGYIDNKKEFLQGILDREKIGDTSWENGVAIPHFIGDVVKTSFISLLYIKGSGVKWSEENPPVNLIFLICMSKKQQGNEHLKAIAFIAKLFEDDAFQNALRGFVTTDDIYYYIENVQRKAKEEVFGATKAEKIVAVTACPVGVAHTYIAAKKIENEAKKQGYSIRVETQGSIGIENALTEEEIKNASVVILAVDKDIDEKRFEGKRVYKVSTVKAINNTENIIKESFNAPVFKSKDSGTNSDTKASVATGKGSFYKYLMSGVSPMIPVVASGGILIALSIAFVGIGPDGPNFAEHPFYKQIADIGSIAFGMMLPVLAGFIAMAIADKPGLTPGLVGGVMSGNVKAGFLGAIFAGFLAGYVARFLARRSVPEWLRPVMPIFVIPLISTIIVGFFMLYFGVYIGKFMGVLESGLKSLQSNSETFGVLGKIFLGLVLGSMITVDMGGPFNKVAFLFGVGLIPQVPEIMGMVAAAIPVPPMAMGLATFLAPKLFENEEKESGKIAFLISFIGISEGAIPFAASDPGRVIPSIVVGGAVSSIIAAFLGVANHAPHGGPIVLPVIDNKFGFIIAIAVGVAVATALVIFLKSLKLKESE

SEQ ID NO: 226 - protein, 394 aa, Borrelia burgdorferi
MAKEVFQRTKPHMNVGTIGHVDHGKTTLTAAISIYCSKLNKDAKALKYEDIDNAPEEKARGITINARHIEYETANRHYAHVDCPGHADYIKNMITGAAQMDAAILLVAADSGAEPQTKEHLLLAQRMGIKKIIVFLNKLDLADPELVELVEVEVLELVEKYGFSADTPIIKGSAFGAMSNPEDPESTKCVKELLESMDNYFDLPERDIDKPFLLAVEDVFSISGRGTVATGRIERGIIKVGQEVEIVGIKETRKTTVTGVEMFQKILEQGQAGDNVGLLLRGVDKKDIERGQVLSAPGTITPHKKFKASIYCLTKEEGGRHKPFFPGYRPQFFFRTTDVTGVVALEGKEMVMPGDNVDIIVELISSIAMDKNVEFAVREGGRTVASGRILEILE

SEQ ID NO: 227 - protein, 218 aa, Borrelia burgdorferi
MYMIRLKVLILCLFGIFVLNGFADTNFEFNFGGGVAFPVSPFSSFYNEALEINAKLKQNLPSDLSPIEKEEIVQNFSDLANIAKAGIRYGTYAQFGAKFDDFVSIGFELLFNINLLKAIKRSDGTANENFSFIMAITPRFYTKLDFFVLALAFFTGPKINIATSSADSVLAELGTMGWDIGARLSFSFLILEGYYVWNIKNPKFSDFKFGIGFEFGIV

SEQ ID NO: 228 - protein, 586 aa, Borrelia burgdorferi
MKKGSKLILILLVTFFACLLIFPTLKWYFLMSVEDKKISSYSQEALRDYSKKKALNDLVKLKELYNKDPNSSIPASLSYLIPIAKNNYRSSMKIPPNIFTAKTLREGFLTDSDMGEVSLEIYRYYENIKKGKSRIIHLGLDLSGGMSVTISLDYSSVEKKLGRSLTFAEREDAIYRIMQILKDRVBRFGLTEPKIVREAGGNKIFLDIPGEKDESRVSTLLSGKGNLTFYVVDDESTSLLHRKILEAGSLFSIPEIQASMNLPDSKQIFPWYVKDSYGVDDESSVRYYVVDASPENSFDGAHIKDAGVSNDPRTGRDTVAFSLDVDGSEKFFKFTQKNVGKSLAVVMEGKIKSVAGIGYAITGGNVSIQGDSFDKKEAQDLALVFKTAAFPVDIKIDDLRIIGPTLGARTIDLGIKASALALCLVFLFICVYYGLSGVVAGFSLVIYNVFLILAILSAFNFTLTLTSIAGLILTMGMAVDINIVIYERIKEEIREGRRFENAFEAGFKKAFLSIMDANITTFIAVLFLTLLGTGVIQGFAWSLSVGIVASLFSSLIFSRFILEFIISVRKSKFISISWSSKYAKSN

SEQ ID NO: 229 - protein, 344 aa, Borrelia burgdorferi
MVYMKRKAKSILFFLLSTVLFAQETDGLAEGSKRAEPGELVLDFAELARDPSSTRLDLTNYVDYVYSGASGIVKPEDMVVDLGINNWSVLLTPSARLQAYVKNSVVAPAVVKSESKRYAGDTILGVRVLFPSYSQSSAMIMPPFKIPFYSGESGNQFLGKGLIDNIKTMKEIKVSVYSLGYEIDLEVLFEDMNGMEYAYSMGTLKFKGWADLIWSNPNYIPNISSRIIKDDVPNYPLASSKMRFKAFRVSKSHSSKEQNFIFYVKDLRVLYDKLSVSIDSDIDSESVFKVYETSGTESLRKLKAHETFKRVLKLREKISMPEGSFQNFVEKIESEKPEESSPKN

SEQ ID NO: 230 - protein, 636 aa, Borrelia burgdorferi
MVSMKLKARMLLLVLILIAFFISILFFAFGMLINSKLVDQQFNLMINLIESIKSSFNLYISSMEEKVRVSSMYFNSAEKFNEASKIKSKRLSFISDQSEILIQTGSNMMVTDKEGKIVFTTAVKDNSDFGKSIGDREYFTKLKESNSIVYNSFVMLADPGSIEESLLKDISKIKNKKGQIPYILIGMPLRDFETDNIFGYFMFLYSMDYIYRSFRGINFGILSSGRALAYDTTGRLLVHHVVLPGDILTDISASYSNIIKKTSEDLLQKNKEISTVYYYDPKSNKKYVGISQKVLLNLSNNKFILLMRTSEDDFYYMSRATTIILAISFVFTLLMLAIATLYLVKKLSSSLNKILEYSERLASGNFTADINFGKWDTVELYSLYEGLEQLRTNFSSVAKGVIENLDYLYENAIQIANASQNLSSGAVEQASTLEQMTANIEQISQGVSENTENAATTEKIAVNTNERTKEGHKSVVKAIEAMTVITEKIGIIDEITRQTNLLALNASIEAARVGEKGKGFEVVAAEVRKLADQSKESAREIIDIANRSLTVASRAGENFEQIVPGMEQTARLVKNISNESYKQSVQIEQFKNAIEQVSQLVQTTASSSEELSAMSEKMLESVKDLKESVDYFKIEK

SEQ ID NO: 231 - protein, 357 aa, Borrelia burgdorferi
MDLLDLLEKEKQINKNKGVFMTKPKIFSINKEKIKILIIVVLTSTFLLGIIFSNENKVARILEEKFFDFDFNLISKIETELEGTLTKLGKDWILTYNKQNIPVDNKKVNSLIKALDELQKNKLVSRDQKKHKELGIGENPSFKLFDNNNKLLTEIFVGKSGEGDSRLAYIKGSDENVYLTKNIFLSYKGNSYNTFSDTTLFQEKNTKLENLSFKIIRKLNKENENNINNNYEIISKDGLYFLNNQKMTKERPLNIIAEFKADGLEIDKSKIDDYNLQYKIEVKWSNKSVNNIEVYFNKNEENDKDILIKKDKDEYYYTTSKWTFFDVFDLEKKLTEKDDISSNDNQEDHHEHHNNAD

SEQ ID NO: 232 - protein, 335 aa, Borrelia burgdorferi
MNKLMLMLITFATSLLAQTNKASTGLKTDQSFNNSLSESVKLKEIADIYPTNTNFLTGIGIVAGLAGKGDSIKQKDLIIKILEENNIINEIGSNNIESKNIALVNVSLQVKGNTIKGSKHKACVASILDSKDLTNGILLKTNLKNKEGEIIAIASGITQPNNKLKGSGYTIDSVIINENQNINHSYNIILKKGNYTLINRIHKILTSKKINNKIKSDSTIEIEAKNISLLEEIENIKIETNPKILIDKKNGIILASENAKIGTFTFSIEKDNQNIFLSKNNKTTIQVNSMKLNEFILKNSNNLSNKELIQIIQAAQKINKLNGELILEEIDGNQN

SEQ ID NO: 233 - protein, 265 aa, Borrelia burgdorferi
MMRALWTAASGMTAQQYNVDTIANNLSNVNTTGFKKIRAEFEDLIYQTHNRAGTPATENTLRPLGNQVGHGTKIAATQRIFEQGKMQSTNLLTDVAIEGDGFYKILLPDGTYAYTRDGSFKIDSNRELVTSQGYKVLPNILFPEEYIQNSITISEEGIVSVKIDTSNEPIELGQIEISRFINPAGLSAIGSNLFKETAGSGQEIAGIPGSEGMGRLRQGILEMSNVSIAEEMVTMIVAQRAYEINSKAIQTSDNMLGIANNLKRQ

SEQ ID NO: 234 - protein, 722 aa, Borrelia burgdorferi
MRKILKLKIGRDELVFETGFMAKQANGSVLATYGGSSVLATVCCSSNVREDLDFVPLSVEYNEKYYAAGKIPGGFIKREGKPKDKEILVSRLIDRPMRPLFDKRFGREIQVIPTTLATDQLNPPDIVGMNAAFTAVFLSDIPFNGPIAAVRMVYLNGKFIVNPSFEEIHDSDLDIVVAGSLNGITMVEGGANEVGEDILLSAIDGAHEYIKQICNAQKEFLDIVGKKEKLPLAFEEKIFEFKDELRDFVYADLKEACFVKGKLNRDKAITLLRNKSYEYFSSLEKLTDSNESLFHKAFDDFEKEIVRSSILNDNIRTDGRTPNEIRDIISEVDILSRTHGSALFTRGETQALAVTTLGTSIDEQIMDDIDGDKRLNFMLHYNFPPFSVGETGRLMTGRREIGHGHLAQRALESMVPGKNDFPYTIRVVSEVLESNGSSSMATVCAGSMSLMSAGVPVKGQVAGIAMGLISEGDKYVVLSDILGEEDHLGDMDFKVAGTKNGITGFQMDIKIENVTKDLMRDALEQARIGRIHILSIMNTVISNSRVGISKYAPKIVQLQIDIDKISLVIGSTGKTVKAITDEFEVKVQIEQNGKIILFGDDDFKMQKAKERIESIVREPKVGEIYEGTVKKINSFGAFIELTPAKEGFLSTRLKPRDSKYGSGRFGNSNRYSRFGGGGENIRGNAGLVRPPKLEEGQRIKVKIIDIDKFGKIDLEIVRDKDY

SEQ ID NO: 235 - protein, 469 aa, Borrelia burgdorferi
MKYFYFLFFLLIFNVYAQNVNSPALPSPPLLPEITENKPVERENSSKGENFSNVGLDGKYVNDTILYGLDSQVTSIIKALKKSSDSQYNFSLKKRLEKTFNAELKREILELFISLKYSGGIDTANYILENYESKRYSNALFGLAISYLKEFDDKEKLKKTLIDILENKEGNVVSIAAYYLGELNSLEYSKNMMEVFEKYSGNDGARREILIALGKMSAVDYQDRIYEISLDNYEGPSIKAAAIEALSYLASDKVTENADLYLQSNNNNLNVKLAIIASLSKDPSLKSKEILQGFLRDSDDNIRFKAINAIKGHRDSSAKDILIYKLKSDPSLKVREASAKALIDMDLGNIEIKNIMFDFKIDNNFKISMFSYLLDKDSLKALSIALEIVNKENINRPSNVLRGVASMLAGKKGNFDNFYSKIIDSKNIDLRHLALKGAVYNKSSSLSDKLKKIKSETNSEYIKMLLKDY

SEQ ID NO: 236 - protein, 323 aa, Borrelia burgdorferi
MKKKNLSIYMIMLISLLSCNTSDPNELTRKKMQDKNVKILGFLEKIQADNKEIVEKHIEKKEKQMVQAASVAPINVESNFPYYLQEEIEIKEEELVPNTDEEKKAEKAISDGSLEFAKLVDDENKLKNESAQLESSFNNVYKEILELADLIQAEVHVAGRINSYIKKRKTTKEKEYKKREIKNKIEKQALIKLFNQLLEKRGDIENLHTQLNSGLSERASAKYFFEKAKETLKAAITERLNNKRKNRPWWARRTHSNLAIQAKNEAEDALNQLSTSSFRILEAMKIKEDVKQLLEEVKSFLDSSKSKIFSSGDRLYDFLETSK

SEQ ID NO: 237 - protein, 169 aa, Borrelia burgdorferi
MKKTIIVFIILAFMLNCKNKSNDAEPNNDLDEKSQAKSNLVDEDRIEFSKATPLEKLVSRLNLNNTEKETLTFLTNLLKEKLVDPNIGLHFKNSGGDESKIEESVQKFLSELKEDEIKDLLAKIKENKDKKEKDPEELNTYKSILASGFDGIFNQADSKTTLNKLKDTI

SEQ ID NO: 238 - protein, 162 aa, Borrelia burgdorferi
MCGRRMKNILLFVILLFFSCKEFNYSDLRRRPSKVLNASNGASNKELKISFVDSLNDDQKEALFFLEQVVLDSNPDKFNQIFNLNEEKVKEMLVTVVKCLKAKRKAKMALESSNVANVANAKQQLLQVEKTYIDNLRQSFMTTKNIEEACNLVKNYDASASF

SEQ ID NO: 239 - protein, 194 aa, Borrelia burgdorferi
MTALLERLKQKQKELKLDADNKPKAKKGKKATVFSKIEEVKGRKIYHTKIFNDFYTFGISKNEPTKFFISLRGIFNIEDISMFHLFSVREDDEFMGIYYGIRKLDKAFIVKNFNKKETYTLRKCEYIEFRFKKGSVFCYLNGLHILLKKDRVNSPYYNTLLNIILELETELYAFYSKKLSKGGIIPEWIKKRQK

SEQ ID NO: 240 - protein, 213 aa, Borrelia burgdorferi
MMQRISILLMLLAVFSCKQFGDVKSLTEIDSGNGIPLVVSDVVKDLIPKEISLTPEEAEKLESLKVFLKDAMSVNGREEALKAEYEKSYKEFFDWLSKDVNRQKEFISSFDNISSIVSKAVDASKKRRPTEQQSLGFKEYVCYKIKNSKGEALSLFFQKVVDAFGADPYKKDNDESVQKPVKCNEEIFKVIKKVLTESESNNELKNLKNYGNV

SEQ ID NO: 241 - protein, 202 aa, Borrelia burgdorferi
MSDSIDFQKEIEKLKASKVELESQLESLKKNQAQKIVLDKLQSVNASSYPVFESHKFQDEGLYFAQKGGLKSSSADKFENYQALDFCYKCGVKLIVNGSNLQIAKGGGSDLYGVCVDFDDFSRTGTVVPITCSFECVLITKDKTIKAEDKLIINSEGVLEKSSKNASVIHALALGPALEFKDRRDVYGVRVLFLVKQIKDSI

SEQ ID NO: 242 - protein, 162 aa, Borrelia burgdorferi
MRYKLKILTRAKTHTYVLKDIPMYDWDSVLGFDVERDELISKLNDLRTLKEITKLMISRGFLDEFYEILNKERRYSELYKYALPTILFSVQYSLFETIEGFKKPGLVYIESFQDKNGDYIKYDYINERWSYDLITNSKPSDLNSEDSLEPGFESLLQEGSNE

SEQ ID NO: 243 - protein, 414 aa, Borrelia burgdorferi
MNGKLRKALKIAIFTTLLLVISCNANMDTNDKNKALNEYKLKNISEVIKNSLQLESDPKLKKEPESNINQSTPPILEIEKIEPGKQEMSLKSEFGSESLMPLEEPEEANMAKSEEEIAKIQEKLLLIGASDEITDQELGENMQKFLNPTTVEFKISTTTNETILTTIEEEEINNNKDKIFDHKEENVTLGNNSLENATLNKNTITLAQNQKYTTHLKNDDKFITKEYLKQVRDSLDKALNAIKNLETSKEFRELENLPKDQENSPSAKKESTESNINNTNTENIEIIKNRLLEELNKSELIFEDTKDPLGTSTIKKVIDAAKKWQEKENSSQIDWDLGFKFHPNPKFYNKLTAQEYKVLAEKFTKVKNEYKNTKEQLKAESKLTTNSISKIINATKEFANQVINLILLVEKNYQ

SEQ ID NO: 244 - protein, 345 aa, Borrelia burgdorferi
MKYLKNISLFLLILGCKSIPNGNFNLHDTNHKLGKLKFQEDSIISRNYDNKISIVGVYNPLTEKENFKVNIFIKKKGLQIDPENILINEEKINYSKYKAELKVKSSFNKSIISISLTNSRDLLTYIYDKSTGKYINIDFKDNWNVSHSIKFNKEYILAYITDFDKEIKISKNILQKRIDNRKIEIEKTELKTEYNEIEDYYIYSMKIPKLFEKSDAPSETYETFVIANYYPCENLNILFLNLSLYSDKLRFLNSIYDENDRKLKMEPPVRALKNSKTIKETLNIVLSPQKIIELAKNIEKDITLKLKSYGEKGEFTFEIYKPLLLKFLKEVDHCIKNLQSSRHKF

SEQ ID NO: 245 - protein, 165 aa, Borrelia burgdorferi
MILYQNQLKFLKLLVFFLLISCTSLNVEHDQFGKTFRIYQSLNKNAELKGIFNYKTGITKIVLYTRFRNHSITEQNPLLLLDGTKIEGKVSYKRDNNHFFGNWINYSSFVLTKSLLERMIKEEDASYKNKEVKIRIGLEDLSLKKYKILDFLVMVESIENKDYKS

SEQ ID NO: 246 - protein, 186 aa, Borrelia burgdorferi
MEKKRVVKVLTKKIDTYVEQNLMINESKISYYKTLKEKLNDNFKKEIFHRVENIKILKEIKDNQYYKFDGYKTFLDFIKDFDVAKTQAYKYLRLATALQEGLIKEDYLIENGIKNSYNFIKDKESPALKKSRQNPIKPLRFQLKTQESYDFYKKNAKFTAFILEELLKNQKDFLKKLLRKYEELKI

SEQ ID NO: 247 - protein, 287 aa, Borrelia burgdorferi
MQKDIYISNIFLYIPLFYSCFLTPPKSLKINSIKTEVFDFKIIEEGDITKYNKNPIKESNNNICLTFKEPELNEIKEGEVFEILANGYVTWAKSGDLRDIKDKNNNLIEDLRELKYSYIFSPIRFKTYSLLTFSYTNYSINDNNYKIFGQEVPIAKIIAFESTEEFEKKYEIKSLKLNSEESNIDFEQNRTGFAKINLKETSREPQYIYSYNFGVFDNSLADYFKLFYKKSKCNYMPAYLTIKDKQTNKDKTYEIILNLKLFNDAIRLIFDKYSNLSKEKLKLFIDE

SEQ ID NO: 248 - protein, 173 aa, Borrelia burgdorferi
MSMEQLIAQDLSKRYYYNELTYRDLENLEKQFGIKFDNLVTKIDNVEKNLNLKIDNLDTKIDTVKSELTTKIDTVKSELTTKIDNLEKNLQKDMFNLEQRLEAKLEANNKVLLEKLESNNKVLLEKLESNNKVLLEKLSVKNRVSVVIASVVSPIVLSILSSLIMTLIGNYFK

SEQ ID NO: 249 - protein, 169 aa, Borrelia burgdorferi
MADFDFTKLCKNFVLGVEHKACVHQTETAIVDVESPIIKPGDPVYSSGSSEMGEVLVKAATATAGVGPIRGFALKKADIALLESENYSPGELIPIRRAGEITVMLDNTFATPKIGDFVFLKGGKLVKDGKGGVQVGRIKDVSLDANSKVVLLDVNIGPEFESNGNRKFA

SEQ ID NO: 250 - protein, 266 aa, Borrelia burgdorferi
MKSSVVTTSITEEQIYKEFLRLGMEQLIAQDLSKRYYHNELTYRDLENLEKQFGIKFDNLVTKIDTVKSELTTKIDNVEKNLQKDISNLDVKIDTVKSELTTKIDNVEKNLQKDISNLDVKIDTVKSELTTKIDNVEKNLDTKIDNVEKNLDTKIDNVEKNLDTKIDNVEKNLQKDMFSLEQRLEIKLEANNKLLLEKLEANNKLLLEKLEANSKVLLEKLEANNKVSSEKLKVSNRIVIIAVVVVPTAISILTPFITSLISNYFK

SEQ ID NO: 251 - protein, 236 aa, Borrelia burgdorferi
MKKSFLSIYMLISISLLSCDVSRLNQRNINELKIFVEKAKYYSIKLDAIYNECTGAYNDIMTYSEGTFSDQSKVNQAISIFKKDNKIVNKFKELEKIIEEYKPMFLSKLIDDFAIELDQAVDNDVSNARHVADSYKKLRKSVVLAYIESFDVISSKFVDSKFVEASKKFVNKAKEFVEENDLIALECIVKTIGDMVNDREINSRSRYNNFYKKEADFLGAAVELEGAYKAIKQTLL

SEQ ID NO: 252 - protein, 222 aa, Borrelia burgdorferi
MKAVLATTNITEDQIYREFLRLGMEQLIAQDLSKRYYHNELTYRDLENLEKQFGIRFENLISEISFLEKNLQKDIFNLDAKIDSVEKNLQKDIFNLDAKIDSVEKNLQKDIFNLDAKIDSVEKNLQKDIFNLDAKIDSVEKNLQKDIFNLDAKIDSVEKNLQKDIFNLAQALKKEVQINSQFLLEKLKVSNRIIIIITVIIVPIAISSITNIVMLLIAKFFK

SEQ ID NO: 253 - protein, 184 aa, Borrelia burgdorferi
MRILVGVCIIALALLGCYLPDNQEQAVQTFFENSESSDMGSDEIVTEGIFSSLKLYASEHRLLVEIKKTLISLKDPNYRGVVLPVSDYNEEYFNKFFLDLGSEQSKDLIKLFIMVKNEQNNNKFMRIVRWLYSCIEELYSPDIKYSGEEGSPEYYRNMPRPTAYQQYLKVKRYDYNRPVPILPT

SEQ ID NO: 254 - protein, 260 aa, Borrelia burgdorferi
MLRALLIFLVNISLFSFEKEVKVYIDKIESVHTKYCSGNFEFDFFSPDKIFTNELQNIENVILMKYRRESIQYNYLNLLMSLVLCDVSYLINDPHKYNDLIQKLIRNYNCALKISLEDDNVPADYFRALGELAINLIPHNRKGLYSYFVNAKRHLETALKIDGDNVKAFIPLSILYTVRVSNRDFYKILFAKSYIDRAEDSNLNDRQKYLKELVKSSFLIRTNRRLEAIECLKKATAIFPNGNMAVLAIEKLKEGNSFYY

SEQ ID NO: 255 - protein, 250 aa, Borrelia burgdorferi
MSKLILAISILLIISCKWHVDNPIDEATAESKSALTSVDQVLDEISEATGLSSEKITKLTPEELENLAKEAQDDSEKSKKEIEDQKNTKESKNIEVKDTPRLIKLIKNSSEKIDSVFQTLINIGYNATYAAKSNLKNGLKMVKLLDELLKISVSSNGDKSTQKYNELKTVVNRFNAENSAIKVPLENGSKIEAKKCIKTLMTNVETYFKGVSTELKDKKDDKYTKILAALSEAANKIENAAMAIHLCFNN

SEQ ID NO: 256 - protein, 232 aa, Borrelia burgdorferi
MSKLILAISILLIISCKWYVDNTIDEATVESKSALTSIDQVLDEISEATGLSSEKITKLTPEELENLAKEAQDDSEKSKKEIEDQKNTKESKNIEVKDTPRLIKLIKNSSEKIDSVFQTLINIGYNATYAAKSNLKNGLKMVKLLDELLKISVSSNGDKSTQKYNELKTVVNKFNAENSVSVSFKEHSNSKIETKKCIQTLMKNVETYFEGVCSELKNKNDGEYEKTLTTLS

SEQ ID NO: 257 - protein, 238 aa, Borrelia burgdorferi
MLLGGQSMFRGKEIYFLLFSLLLFISSIIISHGIKNIGTKNENYITVKGLSEREILSTSSSWGLRYSLTGNTINDINKANNLSLSKIKSFFLKHGFSEDHIKMGFMEFNEETYKESLYKYRAYISLTVHTKNIEKMEAAEKNIAELYNQGILISNSGGPRYYFDNINDIKPEMLADSIRNAKLAALEFAKHSSSKLGKIKNANQGYFEFLPIDRSLGDQERYPKKILRIVTTVSYYLD

SEQ ID NO: 258 - protein, 211 aa, Borrelia burgdorferi
MKKYIINLSLCLLLLSCNLFSKDSRSRQKYNFKVPAKSVSNPINKENIDTEKGTNTTLCIKEKDSRIIIKDCINNQELFKVKSKRRYDFKKAMLLGIQTALKVINIGNNNKKLTSIKKHNDHILLEFKDNKIYIIRLSELKKHLLKSKKKPLLGSPIPGGGDAEFVDDPDGRIEAELEAEQEQEMLDREDFGDEEDEELEEEIFGKEKPNN

SEQ ID NO: 259 - protein, 308 aa, Borrelia burgdorferi
MKAVIPSYSHQINTNKSNKLLSKDCKLKKIISVIIYLNKEFEKKYNESIHRIHFDPEKLKEIRVHHQGDILRVLNSNIHRENKKETTINTLRIDLRFLVKLKALEKRMLTFSNNFGEFRGKLCIYKASPIAYKLIDTYFSNTKSDLIKKVKKEKDVLREKKEHCKPQNITENITVYNKQYINIYNKNSIENSFLKKIKSIVSNTKNPIKTLKNTLLNYKDFKNYLKYDYEVKDIKEFFLSKLNIYKHKIHFMRKIAPYKTDFYTLAGEFKDIYTTKWKADKITSFSGHAGTIANNILSKILSKGLKFE

SEQ ID NO: 260 - protein, 282 aa, Borrelia burgdorferi
MKKNIYILNIFLYIPLFYSCFLTPPKSSKINSIKTEVLDFKIIEEGNIIKYDKKPIEERNENTCLSFKEPELNEIKEGDVLELLAGGYVTWAKSGDLRVLKDKNNNLIEDLRELRYSYIFSPIRFKTFFSYNYSINDNNYKILGKKAPIVKIIAFESTKEFEKKYEINSLKLNSEESNIDFEQNRTGLAKINLKETSKEPNYIYSYNFGVFDNSLADYFKLFYKKNNCNYMPAYLTIKDKETDKYKTYEIILNLKLFNDTIKLLINKYSNLSKEKLKLFTDE

SEQ ID NO: 261 - protein, 184 aa, Borrelia burgdorferi
MRILVGVCIIAALALLGCYLPDNQEQAVQTFFENSESSDMGSDEIVTEGIFSSLKLYASEHRLLVEIKKTLISLKDPNYRDVVRPVSDYNEEYFNKFFLDLGSEQSKDLIKLFIMVKNEQNNNKFMRIVRWLYSCIEELYSLDIKYSGEGSHEYNRNMPRPTAYEQYLKVKRYDYNSPVSILPT

SEQ ID NO: 262 - protein, 185 aa, Borrelia burgdorferi
MSDITKIKQEFDKKVAEIQALMKNPQQDSGLLSNSIDFRDQNLIFSNSGGVCTSSKDKIENYPAKGYPYKRGVKLSFGDGTTELEVEAGGGDDLYGVCSDIDEFSGMATVIPITNNFTGYLTLKKDGQNGVNPGDKLNFNQHGELEKVTGAQKSVNAIALSKAHKLTEDLFIVLASVFGNRAIKG

SEQ ID NO: 263 - protein, 194 aa, Borrelia burgdorferi
MYNMTIRENFMETVSTNIASVTQEQIYKEFIRLGMEQLIAQDLSKRYYHNELTYRDLENLEKQFDIKFDNLVSKIDGVKNELNTKIDNVEKNLQKDISNLDIKIDNVEKNLQKDISNLDTKIDSVKTELNTKIDTVEKNLNAKIDSVEKNLNAKIDNVEKNLMSLSEMLKWVLGIMGAMSITMIAGLIFAFISK

SEQ ID NO: 264 - protein, 177 aa, Borrelia burgdorferi
MEKFMNKKMKMFIICAVFILIGACKIHTSYDEQSNGEVKVKKIEFSEFTVKIKNKNNSNNWADLGDLVVRKEKDGIETGLNAGGHSATFFSLEEEEINNFIKAMTEGGSFKTSLYYGYNDEESDKNVIKNKEIKTKIEKINDTEYITFLGDKINNSAGGDKIAEYAISLEELKRNLK

SEQ ID NO: 265 - protein, 378 aa, Borrelia burgdorferi
MNKKTIIICAVFALILSCKNYAIKDLEQNAKGKIKGFIDKALDPAKDKITSSSSKVDELARKLQEEDKIKGVEENNKDELMQGDDPNSGVINSSPVLPENSQDNTPILKAAEQSDGQQEEKVKKVEESEAKVEGKEEKQENTEERNKQELAKQEEEQQKRKAEQEKQKREEEQERQKREEEQERKAKAEKEAKEKAERQKQEEQQKRKAEKEREEQRKEAEKRQVDNEIRTLTGKIDEINRNIDVIKEQTSVGAQGVIDRITGPVYDDFTDGNKAIYKTWGDLEDDNDEGLGKLLKELSDTRHNLRTKLNEGNKAYIIDTRSTEPQLKENVSVSEIKSDLDELKSKLEEVKEYLEDKDNFEEIKEYVAGSEDNYDEED

SEQ ID NO: 266 - protein, 222 aa, Borrelia burgdorferi
MNNLAYKTYNIESIKNEFLNIGFSKEAIDFVFLHNDNYNFEFLKEKIIDIEKNLQKDISNLDAKIDNVEKNLNLKIDGLNIKIDNVEKSLNAKIDSLDTKIDNVEKNLNIKIDSVKNELNSKIDSLDAKIDNVEKSLNAKIDSLDTKIDNVEKTLQKDISSLNTKIDSVEKTLQKDIFNLDNKINVLKNELTASNRTIQVILIMGITLAPIIYSIFNKYFLN

SEQ ID NO: 267 - protein, 141 aa, Borrelia burgdorferi
MLINKIKQDNRTLRPEIQKWGCYFLCLHYYTSLFKQREFNAYEINAAYYRFIGLGYIKSNCFIINPCMILNYYGIRSSVRYESLNYLGAANEFEISEVKIDKVNGYHFIATKNKEILYDSLDLKPRGKIFKVTSKRIFRLK

SEQ ID NO: 268 - protein, 362 aa, Borrelia burgdorferi
MPQDTISVSFIDSRIQTSRPNYYNPLLVYKTAKIKVNKDAASYKILNLTVNNYEKQIETLEKENGNEEDQFGKEKTLLKTAMSNFFNSSEESLKSADLFIYKDKPEELKNYLKVHRHTFVVLINTEGDASDDGLKIYKDDYNKFKMPSTFFVFSTKEQEIKELFKDKGNTEKERNIAVYSNNKDNLHLKFISQYLHQASIFHAVNPYSMPLAATPLVDDTVIGKLRTAKINFYSLLNETGLDGLPAFKEGVDLAGSTIDEQFTYHYIKNEAIIELIKIWNKNNRQNSKLSALQLSGARDNAYTSAIECLLKRFVDRGLIIEYKNLNLTLSPTPQLKLELGVNITYNFSINAVALVITTQDIV

SEQ ID NO: 269 - protein, 194 aa, Borrelia burgdorferi
MYNMTIRENFMETVSTNIASVTQEQIYKEFIRLGMEQLIAQDLSKRYYHNELTYRDLENLEKQFDIKFDNLISKIDSVKSELNTKIDNVEKNLNLKIDGLDTKIDTVEKNLNLKIDGLDTKIDTVEKNLNVKIDSVKSELNAKIDSVKNELTAKIDNVEKNLMSLSEMLKWVLGIMGAMSITMIAGLIFAFISK

SEQ ID NO: 270 - protein, 179 aa, Borrelia burgdorferi
MRNLVHRTYDIESIKNEFLNIGFSEEAIDFVFLHNDNYNYEVLKEKIIDVEKNLQKDISSLDTKIDNVEKNLNVKIDNVEKNLNIKIDSVKNELNSKIDSLDTKIDNVEKTLQKDISSLNTKIDSVEKTLQKDIFSLDNKINVLKNELTASNRTIQVILIMGITLAPIIYSIFNKHFLN

SEQ ID NO: 271 - protein, 186 aa, Borrelia burgdorferi
MNKKMKMFIVCAVFILIGACKIHTSYDEQSSGEINHTLYDEQSNGELKLKKIEFSKFTVKIKNKDNNSNWTDLGDLVVRKEENGIDTGLNAGGHSATFFSLKESEVNNFIKAMTKGGSFKTSLYYGYKYEQSSANGIQNKEIITKIESINGAEHIAFLGDKINNGVGGDKTAEYAIPLEVLKKNLK

SEQ ID NO: 272 - protein, 343 aa, Borrelia burgdorferi
MNKKTLIICAVFALIISCKNFATGKDIKQNSEGKIKGFVNKILDPVKDKIASSGTKVDEVAKKLQEEEKEELMQGDDPNGSGINPPPVLPENIHNNALVLKAIEQSDGQQEKKVEEAEAKVEENKEKQENTEENIKEKEIIDEQNKQELAKAKEEEQQKEQKRHQEEQQRKAKAEKEKREREEAEQQKRQQEEEEKRQVDNQIKTLIAKIDEINENIDVIKWQTTVGPQGVIDRITGPVYDDFTNGNNSIRETWEGLEEESEDEGLGKLLKELSDARDALRTKLNEGNKPYTGYEEPKLKESVNVSEIKEDLEKLKSKLEEVKKYLKDSSKFEEIKGYISDSQ

SEQ ID NO: 273 - protein, 190 aa, Borrelia burgdorferi
MTNLAYRTYNIESIKNEFLNIGFSEEAIDFVFLHNDNFNFEFLKEKIIDLEKNLRKDISNLDIKIDTVEKSLNLKIDTIEKSLNLKIDFVEKSLNAKIDSLDTKINNVEKTLQKDISSLDTKIDSVKNELNSKIDSIEKTLQKDISSLDNKIDVLKNELNASNRTIQVILIMGITLAPIIYSIFNKYFFN

SEQ ID NO: 274 - protein, 229 aa, Borrelia burgdorferi
MNKKMKMFIICAVFALMISCKNYASGENLKNSEQNLESSEQNVKKTEQEIKKQVEGFLEILETKDLSKLDEKDTKEIEKQIQELKNKIEKLDSKKTSIETYSEYEEKINKIKEKLKGKGLEDKFKELEESLAKKKGERKKALQEAKQKFEEYKKQVDTSTGKTQGDRSKNRGGVGVQAWQCANELGLGVSYSNGGSDNSNTDELANKVIDDSLKKIEEELKGIEEDKKE

SEQ ID NO: 275 - protein, 363 aa, Borrelia burgdorferi
MNKKILIIFAVFALIISCKNYATGKDIKQNAKGKIKGFLDKVLDPAKDKITSSSSKVDELAKKLQEEDEDNELMQGDDPNNRAIALLPVLPENSHDNPPVPKVKAAAQSGGQQEDQKAKESKDKVEEEKEVVEEKKEEQDSKKEKVEKQSQKQKEEERNSKEEQQKQEEAKARADREREERLKQQEQKRQQEEARVKAEKEKQEREEQQKQEEEKKVKYKIKTLTDKIDEINKDIDGINGKTIVGAEEVIDKITGPVYDDFTDGNKAIYKTWGDLEDEEGEELGKLLKELSDTRHNLRTKLNEGNKAYIVLEKEPNLKENVNVSDIQSDLEKLKSGLEEVKKYFENEDNFEEIKGYIEDSNSY

SEQ ID NO: 276 - protein, 210 aa, Borrelia burgdorferi
MTNLAYKTYNIESIKNEFLNIGFSEEAIDFVLLHNENYSFEVLKEKLINVEKNLQKDISSLDIKIDTVEKNLQKDISNLDIKIDAVEKNLQKDISNLDIKIDNVEKNLKKDISSLDTKIDVVEKNLNLKIDFVEKSLNAKIDSLDVKIDNVNNKVDYIKSELIAKIDSVEKGLNEKLNTGNRLIHFMILTAAILGPVLNALFMRYLQYIK

SEQ ID NO: 277 - protein, 378 aa, Borrelia burgdorferi; identical to SEQ ID NO: 265

SEQ ID NO: 278 - protein, 183 aa, Borrelia burgdorferi
MRILVGVFIIAALALLGCYLPDNQEQAVQTFFENSESIDMGSDEIVTEGIFSSLKLYASEHRLLVEIKKTLISLKDPNYRDVPPVRDYNEEYFNKFFLDLGSEQSKDLIKLFGRVKNEQNNKFKSEVYWLYSCISELYSPDIKYSGEEGSPEYDRFMPRPTAYQQYLKVKREIERNTINGKIL

SEQ ID NO: 279 - protein, 250 aa, Borrelia burgdorferi
MKYYICVCVFLLLNACNSDFSTNQEDIKYPSDKEKSKSNMEASSKEEDPNKKIKNTLLNDLINLIEIANEHKEKYEKRMQEEPSDQYGILAFQELDLSVGKISEDTPQSKKFRKNTYSPLSAIDVNKLKDLSEIIRNSGQIQGLFNIFNRFGGIFDDSLNHVYSKKDILGGLEILDLDKLKNSFEKLLSIKETFSKMLNQLLLDYKNDKDHIRTETNKLKSHTTALFEQLDKKEDEAYEPKNQIFSISNL

SEQ ID NO: 280 - protein, 324 aa, Borrelia burgdorferi
MGGFNMELFDENYYAKAVANIIGEVKDPIMYKWFSPDQIEDVDLQMGYQRTVKWDAFLNANPTTIANEVNTISTIGFSSEVVRLNYLKLQYKFRHLKQASEKFYTSDSYLGDINNNLLPFSQAYKLASSEIIKLINHFVLTGTVSIQKDGKNQKRLLPNMYGLLNMPHQVKEEVASGDKDKMDKIFEKIEAGLSKLELGDEFSTPMMVIVDPTTSLKLVKPYAAAQGAASSCEKWEDVLIQTIKAINNREDVYIETSNLLKHQILIYPLNPELIKFKPSKYMLPTPNEQVDKDSTDIAHSYIDFVLGGLLATRKTILQVHIKQS

SEQ ID NO: 281 - protein, 149 aa, Borrelia burgdorferi
MLKRGAKMQFYDLREVYFSIGGTQLHSGKLELTSEPTTRAVISSEDKGMPVISLRDPKTITYVFNIEVTLGSHDYILLTELSDEQFYNMDVRKEDKMLDLAFNDRIATKIISNYAIFTEEPSRSYSAEAEKVSFEIRAINCQKTKPNNT

SEQ ID NO: 282 - protein, 238 aa, Borrelia burgdorferi
MTIRENFMETVSTNIASVTQEQIYKEFIRLGMEQLIAQDLSKRYYHNELTYRDLENLEKQFDIKFDNLIFKIDSVEKNLQKDISNLDVKIDTVEKNLNAKIDGVEKNLNAKIDGVEKNLNAKIDSVEKNLNLKIDSLDTKIDTVEKNLQKDISNLDTKIDTVEKNLNVKIDTVKSELNTKIDNVEKNLQKDISNLDAKIDNVEKNLMSLTEMLKWVLGIMGAMSITMIAGLIFAFISK

SEQ ID NO: 283 - protein, 251 aa, Borrelia burgdorferi
MDNKKPKIITIASIKGGVGKSTSAIIMATLLAKEHKVLLIDMDTQASTTSYFYKEILNQNIDIVKINVYRVLKEKIDINDSIVKIKENLDLIPSYLTLNKFLSESIPLKELRLQNNLEFLKRRYHYVIIDTNPSLDYTLSNALMTSNCIIVPMTAEKWAVESLELLEFHMNNLKIKIPIFLVITRFKKNNTHKQLLQHVESKTGFLGFIHEREDLNKKIAKNEEFDMTKDYINEYKGVLSRFLIVYDEYVK

SEQ ID NO: 284 - protein, 178 aa, Borrelia burgdorferi
MNSLTYRTYNIESIKNEFLKIGFSEEAIDFVFLHNDNYNFEFLKEKLINVEKNLQKDISNLDIKIDTVEKNLNTKIDNVEKNLNTKIDNVEKNLNLKIDNLDSKIDTVEKNLNTKIDNVEKNLNLKMDGLNIKIDNVEKSLNQKLSMGNRLVHFMIITAAILGPILNALFMKYLQGGK

SEQ ID NO: 285 - protein, 142 aa, Borrelia burgdorferi
MQFYDLREVYFSIGGTQLHSGKLELTSEPTTRAVISSEDKGMPVISLRDPKTITYVFNIEVTLGSHDYILLTELSDEQFYNMDVRKEDKMLDLAFNDRIATKIISNYAIFTEEPSRSYSAEAEKVSFEIRAINCQKSKPNNT

SEQ ID NO: 286 - protein, 92 aa, Borrelia burgdorferi
MSNLAYNALKIENIRLEFLNKGFSEEAIDFVLLQNDNYNFEVLKEKMNSLEQQIINVEKNFQKDIDSVNTKIDSVEKTLQKDISSLDNKIDI

SEQ ID NO: 287 - protein, 224 aa, Borrelia burgdorferi
MNKKIKMFIICAIFMLISSCKNDVTSKDLEGAVKDLESSEQNVKKTEQEIKKQVEGFLEILETKDLNTLDTKEIEKQIQELKNKIEKLDSKKTSIETYSGYEEKINKIKEKLNGKGLEDKLNELSESLKKKKEERKKALQEAKKKFEEYKNQAESATGVTHGSQVQRQGGVGLQAWQCANSLGFKNMTSGNNTSDMTNEVITNSLKKIEEELKNIGETVEGKKE

SEQ ID NO: 288 - protein, 196 aa, Borrelia burgdorferi
MNKKMKNLIICAVFVLIISCKIDASSEDLKQNVKEKVEGFLDKELMQGDDPNNSLFNPPPVLPASSHDNTPVLKAVQAKDGGQQEGKEEKEKEIQELKDKIDKRKKELEEARKKFQEFKEQVESATGESTEKVKKQGNIGQKALKYAKELGVNGSYSVNDGTNTNDFVKKVIDDALKNIEEELEKLAEPQNIEDKK

We claim:
1. A method of detecting exposure of a patient to *Borrelia burgdorferi* using a patient sample comprising:
 a) contacting a patient sample with a BB0279 (FLiL) protein, wherein said BB0279 protein has an amino acid sequence shown in SEQ ID NO:218 capable of binding a BB0279 patient antibody, and
 b) detecting the presence or absence of said BB0279 patient antibody in said sample based on binding, or lack thereof, of said BB0279 protein to said BB0279 patient antibody, thereby detecting exposure of said patient to *Borrelia burgdorferi*.

* * * * *